United States Patent 7,745,391 (HUMAN THROMBOSPONDIN POLYPEPTIDE) - sequence listing, part 98

SEQ ID NO: 308390 - DNA, 1975 bp, Homo sapiens
acgctccgggcctccaggtctcgcaggccccgccccctcgccgcgggttcgctgttgggcggagatattcgccgccggcgcttgcgcccggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatc

SEQ ID NO: 308391 - DNA, 1934 bp, Homo sapiens
acgctccgggcctccaggtctcgcaggccccgccccctcgccgcgggttcgctgttgggcggagatattcgccgccggcgcttgcgcccggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcttcatagttctttgtaatatgttgaagttaatttgaattgactgattttgttgaactgtgtgtttaagctgttgcattaaaaagctttcttctacatc

SEQ ID NO: 308392 - DNA, 1900 bp, Homo sapiens
ggcctcgcgcggcggccagcagtcctgcccggcctcccacccttccagccccttccgactccggcatcctaccagaaacttcctcggccctttctttccacctgcttgttaactgccctgttggcccccatcctaagttatttaggcctcgttctgagccctgagaagaaagctaaaccctcctcccccgcagcaattcatttttcagttcttcagacccagaagaagaaagtgttctctactccaaccgagcagcatgtcacttgaaggatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatc

SEQ ID NO: 308393 - DNA, 1916 bp, Homo sapiens
acgctccgggcctccaggtctcgcaggccccgccccctcgccgcgggttcgctgttgggcggagatattcgccgccggcgcttgcgcccggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagatgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatc

SEQ ID NO: 308394 - DNA, 312 bp, Homo sapiens
atctcacctccgggcctgctcctccaactcccgcaaccaccgcccgggcctcgcgcggcggccagcagtcctgcccggcctcccacccttccagccccttccgactccggcatcctaccagaaacttcctcggccctttctttccacctgcttgttaactgccctgttggcccccatcctaagttatttaggcctcgttctgagccctgagaagaaagctaaaccctcctcccccgcagcaattcatttttcagttagtatttgttgagtagctgttatataccgcctgtgtaacaagacacaaaaagtccc

SEQ ID NO: 308395 - DNA, 431 bp, Homo sapiens
cagtagtagattaggtctataaattcatcccaatgtctgagcagcttacagaacaagtcttcggattgcactggtgacccagctcatcccctctttctctcttgtagttctcagaataactgtagaatgtgctggaaatggaacattctcagataaggaggaactggccagatcaaactaagctgtgttcccatccctcctgaaacaggatcttatggtgctttagcccaggacgtcaagtatcccctaggtatgaaacccagagtggagcatgctttgaaggtccctcagctacatgcagactagactgcatgtagctgactctaactgccctgggaaactatcctgagctttgacagacctgccatgaatcttaagcttttattgtcccttgctgcctatctgtgaggaataaagttgcttcacttact

SEQ ID NO: 308396 - DNA, 5426 bp, Homo sapiens
ggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaatttttttttttgggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 308397 - DNA, 5372 bp, Homo sapiens
ggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcatctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaatttttttttttgggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 308398 - DNA, 5319 bp, Homo sapiens
cccgctacaacgcccggctaatttttttgtatttccccttccttctttgctttcaaaatccaggcttaggggtacaaaaacctatatgtctgagacaggaagcactccgaagtttgaagaagagggcagcagcccaactcagaagaactggactccccagcactataaggagagagggtggtggttccaccagagatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaatttttttttttgggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 308399 - DNA, 5544 bp, Homo sapiens
ggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagactgtcactctgtcacccaggctggagtgcaatggcgcgatctcagctcactgaaacctccacctcctgtgttcaagagattctcctgcctcagcctcccgagtagctgggattacagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaatttttttttttgggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 308400 - DNA, 2279 bp, Homo sapiens
ggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcaaccagatggaccgcatttaaatgcatgcatattatcttgaaactgggatattctaatggcacaattgaggc

SEQ ID NO: 308401 - DNA, 481 bp, Homo sapiens
ttaaagacagataaaagacttttgtattaattgcaaagtttgatttcttcatttttttcccatacaaacgatcccctgcttttccttctggctcttgctgctttgtgcccacctgagattaaccttggcccaaggattaggctattttatgatcctgtttactccaggacttggatggtctgatttgactaatatgtttgtgtcaacattagagccgatatattgggaagcacaattttcagtggcatcaccgtcattgttattagtgttcatcttttattggaaccacatggatctccttgttctgacatctcctctctctacaggctcagcagtggatttctaaatgtgctagaagtcctgaaacatgaagtcaagatagggctgggtacaggttagtagttcaccatttggagctatggcaaagtggttgattactgtgtaattttctaatgtgactaatttgcaggtgactgttctg

SEQ ID NO: 308402 - DNA, 2344 bp, Homo sapiens
cgacccctaacaggggccctctcagccctcctaatgacctccggcctagccatgtgatttcacttccactccataacgctcctcatactaggcctactaaccaacacactaaccatataccaatgatggcgcgatgtaacacgagaaagcacataccaaggccaccacacaccacctgtccaaaaaaaggccttctgaggtaataaataggattatcccgtatcgaaggcctttttggacaggtggtgtgtggtggccttggtatgtgctttctcgtgttacatcgcgccatcattggtatatggttagtgtgttggttagtaggccccctgcaggccgcgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaatgttccatggtattttcaacggaatacactttgaaagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 308403 - DNA, 5373 bp, Homo sapiens
ggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaaggtaaaaacaattcaaaagtatcgattatcataaattcacaaaatatttttgcaaccagaacacaaaagcaggctagtcagctaaggtaaatttcattttcaaacgagagggaaacatgggaagtaaaagattaggatgtgaaaggttgtcctaaacagaccaaggagactgttccctaatttattctcttggctggttctctcattgaattatcagaccccaagaggagatattggaacaggctcccttcatgccaagggtctttctaagttaatactgtgagcattgagcccccattaaaactcttttttacttcagaaagaattttacaggttaaagggaaagaaatggtgggaaactctccccgtaatgcttagccaactttaaagtgtacccttcaatatccccattggcaactgcagctgagatcttagagaggaaatataaccggtgtgagatctagcaatgcattttgaatcttcactccctaccaggctcttcctatttttaatctcttcacctcagaactagacatatggagagctttaaaggcaagctggaaggcacattgtatcaattctaccttgtgctatacgtaggagagatccaaaatttggatgcttctggagactcttagacatcttttcattgttgtccatttttaaagttgatgattgctggaaacattcacacgcttaaaagcaatggtgtgagttattaatgggtaaactaagaagtgttataggcaatgacttgaaatggtttttaaattgtatggattgttaagaattgttgaaaaaaaatttttttttttgggacagcttcaaggagatgttagcaatttcagatatactagccagtttaggtatgactttggaagtgcagaaacagaaggatactgttagaaaatcctaacattggtctccgtgcatgtgttcacacctggtctcactgcctttccttcccacagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 308404 - DNA, 4367 bp, Homo sapiens
ggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggtggagttagaaagtcaaaaaatagtaccttgttcttgggatgactatccctttctgtgtctagttacagtattcacttgacaaatagttcgaaggaagttgcactaattctcaactctggttgagagggttcataaatttcatgaaaatatctccctttggagctgctcagacttactttaagctcaaacagaagggaatgctattactggtggtgttcctacggtaagacttaagcaaagcctttttcatatttgaaaatgtggaaagaaaagatgttcctaaaaggttagatattttgagctaataattgcaaaaattagaagactgaaaatggacccatgagagtatatttttatgagggagcaaaagttagactgagaacaaacgttagaaaatcacttcagattgtgtttgaaaattatatactgagcatactaatttaaaaagagaacttgttgaaatttaaaacgtgtttctaggttgaccttgtgttttagaaatttgcacttaatggaatttgcatttcagagatgtgttagtgttgtgctttgccttctttggcgatgaatgtcagaaattgaatgccacatgctttcataatatagttttgtgcttcaaagtgtttgacagaagttgggtattaaagatttaaagtctcttaggaatattattcatgtaactccatggcataaatagttgtatttttgtgtactttaaaatcaacttataactgtgagatgttattgcttccattttattagaagagaaacaaattccatgctttatggaatttatgtagactggagtcttcgtgaactggggcaaatgctggcatccaggagccgccaatactaacaggacaggttccattgccatggcctattccacccaaacaatatgttgtagtttctggaaattccatactcagatatcagtctgctagaactttaaaatgaaggacaaatcctgttaaagaaatattgttaaaaatctttaaaccctgtgtattgaaagcactctattttctaattttatccagttttctgtttaactccttataatgtttaggatattaaaattttaggataatgaagagtacataatgtcctacttaatatttatgttaataggacttaattcttactagacatctaggaacattacaaagcaaagactatttttatgcttccataacctagaattaaaaccaaattatgaccttatgataaatctttaagtattggtgtgaatgttatttaaattctatatttttcttatttaattacaaatactataaatgagcaaggaaaaggaatagactttcttaatatattataacactcattcctagagcttaggggtgactctttaatattaccttatagtagaaactttatgtaatatagctaactccgtatttacagaacaaaaaaacacagttccccctcctgtagtataaattttattttcacatacttagctaatttagcagtaattggcccagttttttccctaatagaaatacttttagatttgattatgtatacatgacacctaaagagggaacaaaagttagttttatttttttaataaacaacagagtttgttttgtgagataagtatcttagtaaacccaatttccagtcttagtctgtatttccaatatttctaattcctgagccacgtcaaagatgccttgccaaatttctccccatttctctacggggctagcaaaaatcttcagctttatcactcaacccctgccaaaggaacttgattacatggtgtctaaccaaatgagcaggcttaggaatttagatgagatgtgtaagattcacttacaggcagtagctgcttctagcatttgcaagatcctacacttttaccttctttaagggtgtacattttgatgttgaacatcagttttcatgtagacttaggactcatgtgcagtaaatataaataagtgtagcatcagaagcagtaggaatggccgtatacaaccatcctgttaaacatttaaatttagctctgatagtgtgttaagacctgaatatctttcctagtaaaaataggatgtgttgaaatatttatatgtactttgatctctccacatcacttataacttatgtgttttatttctccaagtgcggtgttcctgaatgttatgtatgcttttttttctgtaccacaggcattatctatacctggggccagattttctgcactttgaaatgttgcctttgcctaatgtaggttgactttctgaattgtggagaggcacttttccaagccaatcttatttgtcactttttgttttaatatcttgctctctgacaggaaagaaacaattcacttaccagcctcctcaccccatcctccaccatttccttaatgttccatggtattttcaacggaatacactttgaaagttctcagaataactgtagaatgtgctggaaatggaacattctcagataaggaggaactggccagatcaaactaagctgtgttcccatccctcctgaaacaggatcttatggtgctttagcccaggacgtcaagtatcccctaggtatgaaacccagagtggagcatgctttgaaggtccctcagctacatgcagactagactgcatgtagctgactctaactgccctgggaaactatcctgagctttgacagacctgccatgaatcttaagcttttattgtcccttgctgcctatctgtgaggaataaagttgcttcacttact

SEQ ID NO: 308405 - DNA, 2113 bp, Homo sapiens
ggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaactattctagagtgaagcccatagtgacaccacgtttttccctctcctgctctgagactttgatgggtgaactgggcaacattgctaaaacccgtgatttgcacattcagagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgtaagaccctcgggcgtctacaaagttctcctgggattagcgtggttctgcatctcccttgtgcccaggaaagaaacaattcacttaccagcctcctcaccccatcctccaccatttccttaatgttccatggtattttcaacggaatacactttgaaagacctgagtgtgaaagactgagagttgaggagttactttgtggatcttgtccaaatttagtgaaatgtggaagtcaaccagaccaatgatggaattaaatgtaaattccaagagggctttcacagtccacagggttcaaatgacttgggtaacagaagttattcttagcttacctgttatgtgacagtgatttacctgtccatttccaacccaaaagcctgtcagaaagcattctttagagaaaaccactttacatttgttgttaaactcctgatcgctactcttaagaatatacatgtatgtattcataggaacattttttctcaatatttgtatgattcgcttactgttattgtgctgagtgagctcctgtgtgcttcagacaaaaataaatgagactttgtgtttacgtta

SEQ ID NO: 308406 - DNA, 1848 bp, Homo sapiens
ggagccagcccctgggcgcggcctgcagggtaccggcaaccgcccgggtaagcgggggcaggacaaggccggagcctgtgtccgcccggcagccgcccgcagctgcagagagtcccgctgcgtctccgccgcgtgcgccctcctcgaccagcagacccgcgctgcgctccgccgctgacatgtgtgccgctcagatgccgcccctggcgcacatcttccgagggacgttcgtccactccacctggacctgccccatggaggtgctgcgggatcacctcctcggcgtgagcgacagcggcaaaatagtgtttttagaagaagcatctcaacaggaaaaactggccaaagaatggtgcttcaagccgtgtgaaataagagaactgagccaccatgagttcttcatgcctgggctggttgatacacacatccatgcctctcagtattcctttgctggaagtagcatagacctgccactcttggagtggctgaccaagtacacatttcctgcagaacacagattccagaacatcgactttgcagaagaagtatataccagagttgtcaggagaacactaaagaatggaacaaccacagcttgttactttgcaacaattcacactgactcatctctgctccttgccgacattacagataaatttggacagcgggcatttgtgggcaaagtttgcatggatttgaatgacacttttccagaatacaaggagaccactgaggaatcgatcaaggaaactgagagatttgtgtcagaaatgctccaaaagaacagccatataagtgaaaatcgtgatgaagttgaagctgtgaaaaacttataccccagttataaaaactacacatctgtgtatgataaaaacaatcttttgacaaataagacagtgatggcacacggctgctacctctctgcagaagaactgaacgtattccatgaacgaggagcatccatcgcacactgtcccaattctaatttatcgctcagcagtggatttctaaatgtgctagaagtcctgaaacatgaagtcaagatagggctgggtacagacgtggctggtggctattcatattccatgcttgatgcaatcagaagagcagtgatggtttccaatatccttttaattaataaggtaaatgagaaaagcctcaccctcaaagaagtcttcagactagctactcttggaggaagccaagccctggggctggatggtgagattggaaactttgaagtgggcaaggaatttgatgccatcctgatcaaccccaaagcatccgactctcccattgacctgttttatggggacttttttggtgatatttctgaggctgttatccagaagttcctctatctaggagatgatcgaaatattgaagaggtttatgtgggcggaaagcaggtggttccgttttccagctcagtgaaagaaacaattcacttaccagcctcctcaccccatcctccaccatttccttaatgttccatggtattttcaacggaatacactttgaaagttctcagaataactgtagaatgtgctggaaatggaacattctcagataaggaggaactggccagatcaaactaagctgtgttcccatccctcctgaaacaggatcttatggtgctttagcccaggacgtcaagtatcccctaggtatgaaacccagagtggagcatgctttgaaggtccctcagctacatgcagactagactgcatgtagctgactctaactgccctgggaaactatcctgagctttgacagacctgccatgaatcttaagcttttattgtcccttgctgcctatctgtgaggaataaagttgcttcacttact

SEQ ID NO: 308407 - DNA, 1139 bp, Homo sapiens
tcctctccaagaattcgtggtttagcaattccttctattctgaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccaatccagcatgaaagcacctttgctgaagacccgatgttccagagtcaaacgggacaactttaaattcaatattctactattgtttatgtaggattgggggagggaaacagctcatagatcattatgaaggaattaggttcctcttctttattagtctgtaagtaatttacatttgagatttgtgtggacagttgatattagctataaaagaaagtcaaaccaaaaagagatactgggtctaaagttgagctaaatggtttacttgcttatttctacttaaatgccataggtgttatgcatacagtgatgacttttttgagtattaaaagaaaaaagaagaaaaagcaattagcctataggagaagcaacgactatgtaattcaaaacaaaactaaaacaaaataagtctatataatgacataattttcttcccttattttcaacacattctggaggaagtaaatgttatctggtgaatttacttgatatttatctgagcaagatcatcaaactaaatgacatcaataatttcatccctcattatcagctgtagttgtgtattgtaactttgtataagattggaatttgttgggttttggggagagaaagatgaagaagtccctgaatttcattttttaatgaatattttccataaaagctgtcttta

SEQ ID NO: 308408 - DNA, 8946 bp, Homo sapiens
gtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttcacctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacgcgagcagacagactggccataggttttagcactgttcagaaagaagctgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctgggatttcagacatacagcaccttagaaatatgtataattcatagcaaatcaccactatctatggttgccaagtaattgttgtgtacaaaggaaatttaggtggctttttatgacccagaaagtaggaaggtattaaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaaaaaaaaaaaa

SEQ ID NO: 308409 - DNA, 5223 bp, Homo sapiens
  misc_feature (864)..(864): n is a, c, g, or t
  misc_feature (942)..(942): n is a, c, g, or t
cttttttctttttctttttctttttctgtttctctcccttactccttcgtctgcatcttcttctcagctgcctttccgccgttcgattcccacttccttcagaagggcgcactcttccctctgaacccctcgccgggcgtaagtgtcaggaggcggcggacgcggagattgcctcgggagcaggcgatgcgcgccgctgctccgcgcgctgcccgggggaggctggcgctagcgggcgagccggccggggctgaatggagggaaggggcgcctggattccatggggtctgcttctgtcttgaaaggaggttgggccggcgaagtggcctccctagtccccgcacacaaagctaaatggatttacctagtggattcgcggtggatgtctgtcatgtagaagtgaggaccttccaggaggagctttaaacaatttctcggccccccacccgccggcacgcactctcgcccgaaactctttgggagtatctctcgagaacctggagccctggaaatctgggagcagccacccgctccgcgcttgctgttcccggggctgcctttccggacaagcccctctccagctgcattcgcctcggctatgtttcggattgtttggggtgctaggcacggcggactccaggaccccgagaagactgtccgaaggagggagaggatgggtgccctggcgcggtgaggcggccggcccctcagcccactccgcgccgcccgctcccctgcgccctctcctctccccgcgccccaaactttgcctcccgcggcggctgcccctcggcgggcgccccgccatgtaccagaggatgctccggtgcggcgccgagctgggctcgcccgggggcggcggcngcggcggcggcggcggcggcgcaggggggcgcctggccctgctttggatagtcccgctcaccctcagcggcctcctangagtggcgtggggggcatccagtttgggagcgcaccacatccaccatttccatggcagcagcaagcatcattcagtgcctattgcaatctacaggtcaccggcatccttgcgaggcggacacgctgggacgacatatatctttagcaaaggtggtggacaaatcacgtataagtggcctcctaatgaccgacccagtacgcgagcagacagactggccataggttttagcactgttcagaaagaagctgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctgggatttcagacatacagcaccttagaaatatgtataattcatagcaaatcaccactatctatggttgccaagtaattgttgtgtacaaaggaaatttaggtggctttttatgacccagaaagtaggaaggtattaaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaaaaaaaaaaaa

SEQ ID NO: 308410 - DNA, 8967 bp, Homo sapiens
gtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttcacctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtaaacaaactacattgttcggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacgcgagcagacagactggccataggttttagcactgttcagaaagaagctgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctgggatttcagacatacagcaccttagaaatatgtataattcatagcaaatcaccactatctatggttgccaagtaattgttgtgtacaaaggaaatttaggtggctttttatgacccagaaagtaggaaggtattaaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaaaaaaaaaaaa

SEQ ID NO: 308411 - DNA, 8909 bp, Homo sapiens
gtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttcacctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtaaacaaactacattgttcggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacgcgagcagacagactggccataggttttagcactgttcagaaagaagctgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggcaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctgggatttcagacatacagcaccttagaaatatgtataattcatagcaaatcaccactatctatggttgccaagtaattgttgtgtacaaaggaaatttaggtggctttttatgacccagaaagtaggaaggtattaaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaaaaaaaaaaaa

SEQ ID NO: 308412 - DNA, 3524 bp, Homo sapiens
aacttatggagaacaggccaaaacccaaataagaaaacaaaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctgggatttcagacatacagcaccttagaaatatgtataattcatagcaaatcaccactatctatggttgccaagtaattgttgtgtacaaaggaaatttaggtggctttttatgacccagaaagtaggaaggtattaaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaaaaaaaaaaaa

SEQ ID NO: 308413 - DNA, 3636 bp, Homo sapiens
agcgggagtcaggagctctcctgtcaccagtattgatttcagaggatggactaaatttcctaggatttccattaagaattaagaaaaaagctctaagcacgcagggtagccagacagacatggatatgagatggcactgtgaaaactcgcagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctgggatttcagacatacagcaccttagaaatatgtataattcatagcaaatcaccactatctatggttgccaagtaattgttgtgtacaaaggaaatttaggtggctttttatgacccagaaagtaggaaggtattaaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaaaaaaaaaaaa

SEQ ID NO: 308414 - DNA, 3532 bp, Homo sapiens
tccacgatgattgtaagtttcctgaggcctccgtagccctgcggaactaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagggaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctgaatctgatgtgcatgatgaacatttctggaaagtaaacactttctctcgactaagaaagtatttttcagtaatttttgattctgtattactacccacttaaaaaatcattctctgttaattattgactatgttttaacttttctggttttacatatatatcattaaatatagttttagtttaacacattaagtagtggaaaagtatagattatacacttgttttgcatattattcaatgatgttcacagcaataaattactaatatgagaaggtagtgcaaaaaatgcattattacattgcaagttgatgtttcaggaaaaattggttgcattacttgaataccttctaaaagaacgataaaaaattttgtagaagagaagaatatctttccaattagctttaatcagcaaaggcaaaaaatgcaaaacatcttttgtgatactttagttgatgaaaaaaaagccaagaagtggcctgggatttcagacatacagcaccttagaaatatgtataattcatagcaaatcaccactatctatggttgccaagtaattgttgtgtacaaaggaaatttaggtggctttttatgacccagaaagtaggaaggtattaaaatgaaaatttaatatccattgcttcttttctagattttcattttttttaatttgccacattaaataattcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaaaaaaaaaaaa

SEQ ID NO: 308415 - DNA, 4846 bp, Homo sapiens
gtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttcacctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtaaacaaactacattgttcggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccgtaagtacctctctgagtatggactgatactcatcgt

SEQ ID NO: 308416 - DNA, 845 bp, Homo sapiens
  misc_feature (16)..(16): n is a, c, g, or t
agagagagagagaganagagaactagtcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagaaaatgacttgaatcccaagtatcttcataccaaacatatcagggttccctgcatagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaaaaaaaaaaaa

SEQ ID NO: 308417 - DNA, 2362 bp, Homo sapiens
gtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttcacctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaaggtctggcgcacctgatgatgggcgaccaaggtatgggctctgttccttttccactctgctttcagtgttttcttgttctgtagctgctttcaaaccatcactgcaaaggatgggcaaatgcttgcaaattatatggctgcaaattaaatacatatcttttgttcac

SEQ ID NO: 308418 - DNA, 2517 bp, Homo sapiens
gtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttcacctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaaataaaattcggtcttcagtgtgttttgccggtgctgttacatgacaatgaccaaggaaaatactgttgtataaatacagcaaagcctctaacagaaaaagacaacaatgtggaaggtctggcgcacctgatgatgggcgaccaaggtaaaagtaaagagaaacttgaaattttcagatggataaggaaggacttcactaatttctgactgcagactccagacatatcttcaataaagcaatgcaggagagctatctaatccattctaaattacatatattccctcaagtaagagaataaaaataatgtcactcaaaatg

SEQ ID NO: 308419 - DNA, 3399 bp, Homo sapiens
gtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttcacctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtaaacaaactacattgttcggtgacaatatcagtggatgggattcttaccacaacgggctacacgcaagaagattataccatgctggggtctgatgactttttctatgttggaggcagtcccagcacagccgaccttccagggtcaccaatccagcatgaaagcacctttgctgaagacccgatgttccagagtcaaacgggacaactttaaattcaatattctactattgtttatgtaggattgggggagggaaacagctcatagatcattatgaaggaattaggttcctcttctttattagtctgtaagtaatttacatttgagatttgtgtggacagttgatattagctataaaagaaagtcaaaccaaaaagagatactgggtctaaagttgagctaaatggtttacttgcttatttctacttaaatgccataggtgttatgcatacagtgatgacttttttgagtattaaaagaaaaaagaagaaaaagcaattagcctataggagaagcaacgactatgtaattcaaaacaaaactaaaacaaaataagtctatataatgacataattttcttcccttattttcaacacattctggaggaagtaaatgttatctggtgaatttacttgatatttatctgagcaagatcatcaaactaaatgacatcaataatttcatccctcattatcagctgtagttgtgtattgtaactttgtataagattggaatttgttgggttttggggagagaaagatgaagaagtccctgaatttcattttttaatgaatattttccataaaagctgtcttta

SEQ ID NO: 308420 - DNA, 2334 bp, Homo sapiens
gtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttcacctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaaataaaattcggtcttcagtgtgttttgccggtgctgttacatgacaatgaccaaggaaaatactgttgtataaatacagcaaagcctctaacagaaaaagacaacaatgtggaaggtctggcgcacctgatgatgggcgaccaaggtaaaagtaaagagaaacttgaaattttcagatggataaggaaggacttcactaatttctgactgcagactccagacatatcttcaataaagcaatgcaggagagctatctaatccattctaaattacatatattccctcaagtaagagaataaaaataatgtcactcaaaatg

SEQ ID NO: 308421 - DNA, 2959 bp, Homo sapiens
gtggtgacaagttagaagcgcttgcggaaggtccccgcccccaggatcaggctccccctgcaaggggacgatgcaaaggtaaaagcacctcgctccgcagcatccagacctggaggggctgcgaccacgggccgagcccacccattccccagccaaaggacgggcccgccgctctccatggtactgcggagagctcagctccgcccttctctttcagaaggacagcacccggcgtcacgtaacccagccttctcaggctccaccaccgccttttccttcccagctctttccctctcctccccctcctcctccttcacctcctcctcctcctcctgctcccctccgttgcctgttctcccctcccgcactcctggagatagacgctcaagcctgacgcctctgaaaaggcagcagcagtcgccttatccatagacctcaggaaattcgctttgaccgatgcatgcttcaggctctggctcgagctgaggggaataaccgggcagatgtctgagtccttaaaaaagacaagataaaaccaaaatgcatcaccaacacacaaccaattgatgtgctggcatcttagcttggccctgcagaggcagagagaaaagaagaggagctgttgcgatttccacatctaacagcttctggctatttcgcaactgctgggtttgagtcctactgttgccgtggctgaaaagagaagtaaaatccaacttgtgagaccacgcacaaggaattaggctttggctgcagcggtgctgaagcccatgctatgacagaagaagcaggcctttgaagctatcctcgggttaagaaatggtgccctaaagaggcaagcatccctttctccgttctgctgtaagacaccacatctgaaggagacagacttgaggcattcacaagcatccaaggatactggctcactgctggcttcctgtactttcttgagaaaagtgttttctttttactgactctcactgcttccttttggcctggtaccactggtggaacctggcagataatgggatttgaggagttaagtatctgttgacactgcagatactcttaaattagttaatcagactcaaatgggtcagtgctttcccttgatcttttgttgaagccttttccagaacgttgtctccaaagtgcatcctccctttggtctggaagttctgtggctaccctgtaccactggggtcaacgttttccagttggaagaggactacagggagagagggcggggttattggaagaagaagaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcaggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagagattaaagaaaaaaaaggaaatcactcaacatattgaaacaacctataatctcatattccttagaagcaacttaggtctttccctatatggcatttaataatgtctatttgaaatgagactttgcttgcacgtagaacaactaaccctcaattggaaagttacttttgtgtatgtgattatcaaatttcaaaataaaataagattagctcaaaataatttggtaaaacctaacctgaact

SEQ ID NO: 308422 - DNA, 791 bp, Homo sapiens
  misc_feature (16)..(16): n is a, c, g, or t
agagagagagagaganagagaactagtcacgagtcttttcttttcccccgtctcattcagtcttactcagggaaagccagttaaataagaagggaagtgtaaaactactaatttacagcttgaagggtttttttttttaagattgcttttctattttatctattaagcttgaaccagtttccatctggaaagattctaaaatataatagaaaataaattgaataatggtaattttaagcagtatatctatgaaatgtgttgtttgggattgatttcaatgtttctccccagcgtaaattttaaagttacatgcaatgattgatatagtttattatcagcaaaattatttctaatattattggcttacacaaactctagcaaaaattattttttcctcaatggaaaaagaaaagagaggaacagagttagaaagagtagtttgcagttgattgaggatttcacacgacttggcataaatttgattacatctctagactgtaacttttctgattgattatgcttcttttttatccatgtaatgtgttgccttttttaaaagaacaaatactacaataacgtgtgaagtggtcaatccctaagacatcaaagaaaggccacataaccctacccttctagtgctttgtgtgattgggtatcaaaggggttttcttcttctttttttgtttgtttgtttttctgttgcaaggccaatttatccattattggaaatgctaagcaagtggaatttactgttttgttaataaaatatttcttaatacaaaaaaaaaaaa

SEQ ID NO: 308423 - DNA, 1719 bp, Homo sapiens
atttagatatgatttaacgtatatgataggatgtgtataggttgtatgcaattactagaacattttctataaaggtcatgaatatctgtggtggatcctggaaccaatggggttgggagggcagcttcaattgttttaaaatgtttcaggccaacagaatatgcttataaatgcttttataacctcatagcttctgtttctttatagttttggcttatttgtaatgtttcctttttctcatgtggtacaaaacatggttatgtaccattacctcttcaactcagccagtggcttggcagtttcccttgtgcagtgtttaaaactgggccacagttttgaatgcagttgtggatattaaaatgaaatagattaggaaagaatagattaagatagaatacagataagaaaataagaaaatatcagccttcatctggcaaagaaaataccagccttcatctggcaaagggcatcatcaggcatcaccaggaggtgctctgtatccataggttccctatctgtgggttccaccaccactgataaaaaatatttggaaaaaaatacaacaatgcaaaataatacaaatttaaaaaaatacaatatatttatgtggtgtttacattgtattcgttattataagtaatctagagatgatttaaagggacgggaagatatatgtaggttatatgtaaatataccattttatataaggaacgtgtatatccatggattttagaatctgtagggattcctggaaccagtcttccatggataccgagggatgactgtattgttctgtgaaatttttgtcccagctacatatttgtatgtatgtatgtttttggtccggtataattgtataatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatattacctgaatagccacttagggcattttgaacacgtggcttgcattgctttgtctttttgaaatccgctgtggcaggcccaaaccttgcctttggtgggcttaagtaaggtctggtttccagtacaaaggcaaaggcaaatgaggattattagtattccattttgccctatggatattctcagtgctttctactggaaactcacaaccaattctgaatatgccacatactgtgtgatttgcccttgctgtccaaccctgttcttgctgccatttaaaaacaatcaggccaggtgtggtggctcatttctgtaatcccagcactttgggaggccaaggtgggtggatcatttgagctctggagttcgagaccagccagggccacatggcgagacctcgtctctactaaaaattaaaaaaaaaaaaaattagctgggcatggcggtggttcatgcctgtagtcctagcactttgggtgccggggcgggaggatcgtttgagctcagcagttcaagaccagcctgggcatcatagtgagaccctgtctctatttata

SEQ ID NO: 308424 - DNA, 1712 bp, Homo sapiens
atttagatatgatttaacgtatatgataggatgtgtataggttgtatgcaattactagaacattttctataaaggtcatgaatatctgtggtggatcctggaaccaatggggttgggagggcagcttcaattgttttaaaatgtttcaggccaacagaatatgcttataaatgcttttataacctcatagcttctgtttctttatagttttggcttatttgtaatgtttcctttttctcatgtggtacaaaacatggttatgtaccattacctcttcaactcagccagtggcttggcagtttcccttgtgcagtgtttaaaactgggccacagttttgaatgcagttgtggatattaaaatgaaatagattaggaaagaatagattaagatagaatacagataagaaaataagaaaatatcagccttcatctggcaaagaaaataccagccttcatctggcaaagggcatcatcaggcatcaccaggaggtgctctgtatccataggttccctatctgtgggttccaccaccactgataaaaaatatttggaaaaaaatacaacaatgcaaaataatacaaatttaaaaaaatacaatatatttatgtggtgtttacattgtattcgttattataagtaatctagagatgatttaaagggacgggaagatatatgtaggttatatgtaaatataccattttatataaggaacgtgtatatccatggattttagaatctgtagggattcctggaaccagtcttccatggataccgagggatgactgtattgttctgtgaaatttttgtcccagctacatatttgtatgtatgtatgtttttggtccggtataattgtataatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatattacctgaatagccacttagggcattttgaacacgtggcttgcattgctttgtctttttgaaatccgctgtggcaggcccaaaccttgcctttggtgggcttaagtaaggtctggtttccagtacaaaggcaaaggcaaatgaggattattagtattccattttgccctatggatattctcagtgctttctactggaaactcacaaccaattctgaatatgccacatactgtgtgatttgcccttgctgtccaaccctgttcttgctgccatttaaaaacaatcaggccaggtgtggtggctcatttctgtaatcccagcactttgggaggccaaggtgggtggatcatttgagctctggagttcgagaccagccagggccacatggcgagacctcgtctctactaaaaattaaaaaaattagccgggcatgtctgcggttgcctgtaataccagctacttgggaggctcaggcaggagaattgcttgaacccgggatgcggaggttgcagtgagccgagatcgcaccactgcacacccaggctgga

SEQ ID NO: 308425 - DNA, 1403 bp, Homo sapiens
atttagatatgatttaacgtatatgataggatgtgtataggttgtatgcaattactagaacattttctataaaggtcatgaatatctgtggtggatcctggaaccaatggggttgggagggcagcttcaattgttttaaaatgtttcaggccaacagaatatgcttataaatgcttttataacctcatagcttctgtttctttatagttttggcttatttgtaatgtttcctttttctcatgtggtacaaaacatggttatgtaccattacctcttcaactcagccagtggcttggcagtttcccttgtgcagtgtttaaaactgggccacagttttgaatgcagttgtggatattaaaatgaaatagattaggaaagaatagattaagatagaatacagataagaaaataagaaaatatcagccttcatctggcaaagaaaataccagccttcatctggcaaagggcatcatcaggcatcaccaggaggtgctctgtatccataggttccctatctgtgggttccaccaccactgataaaaaatatttcttactatgggttaaacaactttataagacattgtgaggaacctggtatcctctggactagatcattcccgtagacagttccattgtgcacacatagtatttcgttaaaatcaggtgactgtttaaaaattaaaaagattttagataaaaatctagatttttactttctcctgaaatatcagaagatggggtctaaattcacactgaggccaagcagtggtaggctcattttaaagaagggctttctgctctctggtttaccccattgtatactaattagcctggtcttacttttatatattacctgaatagccacttagggcattttgaacacgtggcttgcattgctttgtctttttgaaatccgctgtggcaggcccaaaccttgcctttggtgggcttaagtaaggtctggtttccagtacaaaggcaaaggcaaatgaggattattagtattccattttgccctatggatattctcagtgctttctactggaaactcacaaccaattctgaatatgccacatactgtgtgatttgcccttgctgtccaaccctgttcttgctgccatttaaaaacaatcaggccaggtgtggtggctcatttctgtaatcccagcactttgggaggccaaggtgggtggatcatttgagctctggagttcgagaccagccagggccacatggcgagacctcgtctctactaaaaattaaaaaaaaaaaaaattagctgggcatggcggtggttcatgcctgtagtcctagcactttgggtgccggggcgggaggatcgtttgagctcagcagttcaagaccagcctgggcatcatagtgagaccctgtctctatttata

SEQ ID NO: 308426 - DNA, 7865 bp, Homo sapiens
gcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccgactgcaggccgagcgccgaggcctcgacgcggcccacgaacgcgacgtgcgggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagcgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcactgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagccccaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgcttcaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcaggggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaacccaaaaaaaaaaaaaaaaaaaaaaaaaaaaaaaaaaaaaaaacccccaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaacacacacccaagcaacaaaaaaaaaaacaagagatacgacgagcacgagagcggcgcggacagaacagaaaaaaaaagagtgtcggagctcgaccccacaaagaaacataaacagggcaggccctgtagcgtgacaccagcaggaagatacaaaaaataaaggcgatgcgggtggtggacccgaccaactaaaaaaaaaaggaagcggcaggtgaggatagcgacagtacactaccatacaatgtcgagcaatcactatgcaaggacggcacaacaaataaaaaggacgcggcgggggagagtcaacaatacacaccccgccggcggggggtgtaataaaagacttaaacagcagggaacacggcagcacagccgcgga

SEQ ID NO: 308427 - DNA, 7363 bp, Homo sapiens
gcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccgactgcaggccgagcgccgaggcctcgacgcggcccacgaacgcgacgtgcgggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagcgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcactgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagccccaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgcttcaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcaggggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaacccacatgttcctaaagagaatg

SEQ ID NO: 308428 - DNA, 6929 bp, Homo sapiens
gcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccgactgcaggccgagcgccgaggcctcgacgcggcccacgaacgcgacgtgcgggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagcgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcactgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagccccaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgcttcaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaacccaaaaaaaaaaaaaaaaaaaaaaaaaaaaaaaaaaaaaaaacccccaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaacacacacccaagcaacaaaaaaaaaaacaagagatacgacgagcacgagagcggcgcggacagaacagaaaaaaaaagagtgtcggagctcgaccccacaaagaaacataaacagggcaggccctgtagcgtgacaccagcaggaagatacaaaaaataaaggcgatgcgggtggtggacccgaccaactaaaaaaaaaaggaagcggcaggtgaggatagcgacagtacactaccatacaatgtcgagcaatcactatgcaaggacggcacaacaaataaaaaggacgcggcgggggagagtcaacaatacacaccccgccggcggggggtgtaataaaagacttaaacagcagggaacacggcagcacagccgcgga

SEQ ID NO: 308429 - DNA, 6946 bp, Homo sapiens
gcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccgactgcaggccgagcgccgaggcctcgacgcggcccacgaacgcgacgtgcgggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagcgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcactgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagccccaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgcttcaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctgttatagcctaagttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaacccaaaaaaaaaaaaaaaaaaaaaaaaaaaaaaaaaaaaaaaacccccaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaacacacacccaagcaacaaaaaaaaaaacaagagatacgacgagcacgagagcggcgcggacagaacagaaaaaaaaagagtgtcggagctcgaccccacaaagaaacataaacagggcaggccctgtagcgtgacaccagcaggaagatacaaaaaataaaggcgatgcgggtggtggacccgaccaactaaaaaaaaaaggaagcggcaggtgaggatagcgacagtacactaccatacaatgtcgagcaatcactatgcaaggacggcacaacaaataaaaaggacgcggcgggggagagtcaacaatacacaccccgccggcggggggtgtaataaaagacttaaacagcagggaacacggcagcacagccgcgga

SEQ ID NO: 308430 - DNA, 6739 bp, Homo sapiens
gggcctagaggatcccgctgccgctactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcactgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagccccaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgcttcaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcaggggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaacccaaaaaaaaaaaaaaaaaaaaaaaaaaaaaaaaaaaaaaaacccccaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaacacacacccaagcaacaaaaaaaaaaacaagagatacgacgagcacgagagcggcgcggacagaacagaaaaaaaaagagtgtcggagctcgaccccacaaagaaacataaacagggcaggccctgtagcgtgacaccagcaggaagatacaaaaaataaaggcgatgcgggtggtggacccgaccaactaaaaaaaaaaggaagcggcaggtgaggatagcgacagtacactaccatacaatgtcgagcaatcactatgcaaggacggcacaacaaataaaaaggacgcggcgggggagagtcaacaatacacaccccgccggcggggggtgtaataaaagacttaaacagcagggaacacggcagcacagccgcgga

SEQ ID NO: 308431 - DNA, 6687 bp, Homo sapiens
tactactactaaattcgcggccgcgtcgacaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcactgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagccccaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgcttcaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcaggggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaacccaaaaaaaaaaaaaaaaaaaaaaaaaaaaaaaaaaaaaaaacccccaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaacacacacccaagcaacaaaaaaaaaaacaagagatacgacgagcacgagagcggcgcggacagaacagaaaaaaaaagagtgtcggagctcgaccccacaaagaaacataaacagggcaggccctgtagcgtgacaccagcaggaagatacaaaaaataaaggcgatgcgggtggtggacccgaccaactaaaaaaaaaaggaagcggcaggtgaggatagcgacagtacactaccatacaatgtcgagcaatcactatgcaaggacggcacaacaaataaaaaggacgcggcgggggagagtcaacaatacacaccccgccggcggggggtgtaataaaagacttaaacagcagggaacacggcagcacagccgcgga

SEQ ID NO: 308432 - DNA, 5668 bp, Homo sapiens
  misc_feature (33)..(33): n is a, c, g, or t
tgcctgctagtctgactctatagtgatccccgntactgcgctgggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagccccaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgcttcaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcaggggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaacccaaaaaaaaaaaaaaaaaaaaaaaaaaaaaaaaaaaaaaaacccccaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaacacacacccaagcaacaaaaaaaaaaacaagagatacgacgagcacgagagcggcgcggacagaacagaaaaaaaaagagtgtcggagctcgaccccacaaagaaacataaacagggcaggccctgtagcgtgacaccagcaggaagatacaaaaaataaaggcgatgcgggtggtggacccgaccaactaaaaaaaaaaggaagcggcaggtgaggatagcgacagtacactaccatacaatgtcgagcaatcactatgcaaggacggcacaacaaataaaaaggacgcggcgggggagagtcaacaatacacaccccgccggcggggggtgtaataaaagacttaaacagcagggaacacggcagcacagccgcgga

SEQ ID NO: 308433 - DNA, 459 bp, Homo sapiens
acaaaacacagtgtcatgaaggttattcataattgcattatagaggaatgtagtatgtcataagtactttgtatgtagaaaactgttagaggttcaatattcaactcaagtataaaataataataagaaacacttctgatgttaggttgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaaca

SEQ ID NO: 308434 - DNA, 543 bp, Homo sapiens
  misc_feature (129)..(129): n is a, c, g, or t
  misc_feature (133)..(133): n is a, c, g, or t
  misc_feature (212)..(212): n is a, c, g, or t
gactctcacaaaaacgaacggaactttgcgtcctttgtgttacttggcgagttagatggtaacgaaatacgttataaagtcttctttaagctatctagaacgtagtatagaaggtacgagatgggctcntccntaagatgtaatatgttatcattagcatgtgtttatttcatatgtctcaagtgactatggtcactcaggatatacagtanaatcatctacaaagacatgttcactacatcaagtgtctatatatttatgatgaatgactctacagtttactacaaaacagtcgagtatcatattgcatataagatgttatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaaca

SEQ ID NO: 308435 - DNA, 2738 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaaca

SEQ ID NO: 308436 - DNA, 2668 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcaccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaaca

SEQ ID NO: 308437 - DNA, 3449 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaacaactgaagttgtgcaatattttctgataattgctttttttattcttgtgttttctacttaaacataatgtctgtgtcatcaagtattatagtcagacttttctttttttctagattgttaaaattggcaaatgaacttttttaaaaatcaaaaaaaaaaaaaaaaaaaaaaaaaaagaaaaaagagggggggcgagagagagaggattacccgaggagggccaaagtttaagggtaccaaggtttttggaacaggggggccaaatagagaacgccaaataaacacaaacgacaggccccggttaaaccacggtacgaacggggacacagcgcacccggggcacactggaaaggaccctcctcggggggggaccaacggggacacataccgaagactctaacgccaaggacaactcaacctccccacgcccacggggcaccccagagcaaacatcgcgcgacaaaccaattgcccacgactaactgacattgcagggggcaggaccaacaacaaacgaggaaccagcacagagaaacaaacgcacgaggcacgacagagagacgaggagggagggggccaggcagcgggagggaagagacgaggacgagcgcgggaggaggcccaggcacgagggccgacgacagcggcaggaaacagagagacacgaagctgaccaccacgccatagacaacgagcaacaacgagcaaccac

SEQ ID NO: 308438 - DNA, 2887 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaacaactgaagttgtgcaatattttctgataattgctttttttattcttgtgttttctacttaaacataatgtctgtgtcatcaagtattatagtcagacttttctttttttctagattgttaaaattggcaaatgaacttttttaaaaatca

SEQ ID NO: 308439 - DNA, 2568 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaaca

SEQ ID NO: 308440 - DNA, 3501 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaacaactgaagttgtgcaatattttctgataattgctttttttattcttgtgttttctacttaaacataatgtctgtgtcatcaagtattatagtcagacttttctttttttctagattgttaaaattggcaaatgaacttttttaaaaatcatcttccatgttgcagttagtctttcttttcattacaagtctttcacagaagtttggtggtaatattgaaagaactagcattgggcagaatgtgtcttttttaggcactttatattctcaacatacaatgttaagaaccatcaattttgacttttactaagttgttaaataaagttataatacagctgtgaagggctaaagttagagttgattacataagtaagtattccccatataatcttttaaaaagttgtgtatgattattttaaaatctctctctctaaaaaaaaaaaaaaaaaaaaaaaaaaaaatttgggggggggtgtgggcctggaaaaaggtttttaagaaccttgtggtggggggcgcgggggccccccatgatgggtcagcgtctgacaccactgtggggcgacaaaggtggggcccacaggaagaagaacccgcggacacacacaaacgtgggtgggggttttccccccaaataaaaagcgcccgcggggggacacaccagcggtgttttctgtgaaccaactcccaatgggggtcccgaggggcacacacgcggggctcttcaaccagggggccccagagaaggcgagaatataaagtacc

SEQ ID NO: 308441 - DNA, 1622 bp, Homo sapiens
tgagagaccgtgttgcaatgtgtggcacggtctctcatgagagaccgtgttccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaaca

SEQ ID NO: 308442 - DNA, 3300 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaacaaaaaaaaaaaaaaaaaaaaaaaaaaagaaaaaagagggggggcgagagagagaggattacccgaggagggccaaagtttaagggtaccaaggtttttggaacaggggggccaaatagagaacgccaaataaacacaaacgacaggccccggttaaaccacggtacgaacggggacacagcgcacccggggcacactggaaaggaccctcctcggggggggaccaacggggacacataccgaagactctaacgccaaggacaactcaacctccccacgcccacggggcaccccagagcaaacatcgcgcgacaaaccaattgcccacgactaactgacattgcagggggcaggaccaacaacaaacgaggaaccagcacagagaaacaaacgcacgaggcacgacagagagacgaggagggagggggccaggcagcgggagggaagagacgaggacgagcgcgggaggaggcccaggcacgagggccgacgacagcggcaggaaacagagagacacgaagctgaccaccacgccatagacaacgagcaacaacgagcaaccac

SEQ ID NO: 308443 - DNA, 2811 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatggaaagtcaagttaaattttaaatattaagaattctgatttattgagattgaattatgccaccacgtttatgtaaaaatgaaggtggcaccgtggtgagacctaatgagaaatagttactcagttgtaaaaattttgatttattctctttcttctgacctccttgcctcttgtcttgaaccatagcaaaaggatactgcatctctcattactgtagtgctgaggttattgaagttatacaaaacacatctcagtctctgtttcttggaaaggtatctattacatcctgctagctgactgacaaaactaagcagggagaataaagataattgtattttatgttttgcacacaaacgcagaatttgtataaccatatgacttcatagttgtgatctcaaaaaagaaggaatttctcctttgtttcttgcagttaatgtaagaatactttaaatctctaagcttctgaagtgttagaggtagagatggtctagtaaagatgtagtagtaatgttttatccatttagcatgtgtttattttttcatatgtactcaaaggtgacttattggttcacctcagtgatattacagctaaaaaaatcattcattagcaaaaggaaaagtggtctcaacctaacatcagaagtgtttcttattattattttatattgagttgaatattgaactctaacagttttctacatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaacacccaataacataacttcgaggggggccccggaccctttgccctatagtggagccgattaccatccccggccct

SEQ ID NO: 308444 - DNA, 1989 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgtttgcagttaggaaatgcagaattcaaagtgatctcctagcttgtaagcaaactgagatgcactatcccttttctataaaaaataagttaatgtgtcaagaaaccaactctattaaggtggggtttaatattaccctttcctatgtgttttatctaattattttggttgttaatatggtgataatgtgatagccggctatcacattatccctataaggtctaaaggtgttattaaggaatatgtggctaaagaggctactacttgaatcttgttaatgaatagaaataaccgtccattttgttacacagtaatataacccctaactggtaaataaaagcacaactagccgggcgcagtggtcacgcgtgtaatcccagcactttggttgatatgtgatagccgggatcctcta

SEQ ID NO: 308445 - DNA, 1680 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctcctgcatggagccagttgatgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattaggaaaaagatagtagttatttttcctaaatgaaataactttcttctcttccccttccccacccgaattcttttctgaagttgctggcatttgggtcaaggttttattaaaagctacattttataacactggcacacacaaaaaagtagttttaagcttgtttgcacagttctttttttccattggaaatggaattcattgccttaggtctttttaaatagtgtattattatcgttggggctggctctatgcttgaaaaccagtttatttataacctgttataagtgctatattctgttcagctagagaacgcgaaataaagggggtctctactgtcaggcaatcggatgcctattccttcttataacgggtattcataaattggcgcaaatgggagatgg

SEQ ID NO: 308446 - DNA, 1364 bp, Homo sapiens
acgcggtgcccgagccggcctcgttctggctgccgccgtctcgctgaggcggagtaggatgaggcccgcggccgtggctccggcgtcggcgggggcagcagcagctgaggcagcagctgaggcagccgcgacggccgcgcccccccccgctgacctggattaggcccagcagctccgtggccgccgccgccccgcgggggggcggggtggggaagtgcttcgtctccccgcccccccccccccatcgctgcctcgcaggaggcgaacgccgcgaccccagcggagcccgcggcccagccttgatcccccaaccccgggggctggcatgagcggcccctcggcggcaccgtggggcggtggagtcgcctccgcctgatccccggcctgtcgcccgaccccacctcgccaaccgaggcggaccgcggagtgtgcgaacgaccccaccgctgctttctcctcccccagatcacgcaccccagctccggaagatggggaactgcctcaaatcccccacctcggatgacatctccctgcttcacgagtctcagtccgaccgggctagctttggcgaggggacggagccggatcaggagccgccgccgccatatcaggaacaagttccagttccagtctaccacccaacacctagccagactcggctagcaactcagctgactgaagaggaacaaattaggatagctcaaagaataggtcttatacaacatctgcctaaaggagtttatgaccctggaagagatggatcagaaaaaaagatccgggagtgtgtgatctgtatgatggactttgtttatggggacccaattcgatttctgccgtgcatgcacatctatcacctggactgtatagatgactggttgatgagatccttcacgtgcccctctgcagcactgctttcatcctatgagactaattgagccagggtctcttatctgacttcaagtgaaccaccattttggtggttttgatcttttgtcactgagcccaaagagccagggattaggaattaagatcgtgcacaaaagtttccttaaaattcctggatggctgcagatgttgggggaaaaagtacgtgatattttagaaacttagtgggaaaagtaggatggtatttttatgtaaagccttgacccaatgtttaaaaatataattgtatttagatcttgttattgctccagtacataggaattgtgtaaagtgttaacagcagctgtatttgtttaaattgtgtgtattgaagattcgtaccctaatttttcttaagttgttgcattaggtcaagtcttattaaagcttctcttatacattgccttacataatagtctttatctttttgccactctttt

SEQ ID NO: 308447 - DNA, 1098 bp, Homo sapiens
catgaaggttattcataacactgtgttttgtatgtagaaaactgttagagttcaatatacaaaacacagtgtcatgaaggttattcataattgcattatagaggaatgtagtatgtcataagtactttgtaaagatttgacattcaactgtagtatccatatgttgcttaaatttccttatgagccccatgatggaaagacttaaagatgaatttgagaaaaattgaaagaaattagattatcaggttctgttaaattgttacatgtatcttgcttaaatttctgtttattaatttatatccacccaagtacataaagcaaatttggaggaaacaactgaagttgtgcaatattttctgataattgctttttttattcttgtgttttctacttaaacataatgtctgtgtcatcaagtattatagtcagacttttctttttttctagattgttaaaattggcaaatgaacttttttaaaaatcatcttccatgttgcagttagtctttcttttcattacaagtctttcacagaagtttggtggtaatattgaaagaactagcattgggcagaatgtgtcttttttaggcactttatattctcaacatacaatgttaagaaccatcaattttgacttttactaagttgttaaataaagttataatacagctgtgaagggctaaagttagagttgattacataagtaagtattccccatataatcttttaaaaagttgtgtatgattattttaaaatctctctctctaaaaaaaaaaaaaaaaaaaaaaaaaaaaatttgggggggggtgtgggcctggaaaaaggtttttaagaaccttgtggtggggggcgcgggggccccccatgatgggtcagcgtctgacaccactgtggggcgacaaaggtggggcccacaggaagaagaacccgcggacacacacaaacgtgggtgggggttttccccccaaataaaaagcgcccgcggggggacacaccagcggtgttttctgtgaaccaactcccaatgggggtcccgaggggcacacacgcggggctcttcaaccagggggccccagagaaggcgagaatataaagtacc

SEQ ID NO: 308448 - DNA, 3255 bp, Homo sapiens
  misc_feature (1)..(2): n is a, c, g, or t
  misc_feature (4)..(4): n is a, c, g, or t
  misc_feature (7)..(8): n is a, c, g, or t
  misc_feature (11)..(11): n is a, c, g, or t
  misc_feature (13)..(13): n is a, c, g, or t
nnanatnngcntnaaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatagagaagaaaaggcaagaagagaattctcaaaatagttcagaaaaagtcatgtttcaaagtactcacattcttccagatgaggaaaaaatggtgaaggaaagaaaaaggaaattgaaagaagtattaatccaaactttcaaagaaaatcaacagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacagaaaacaacaactggccactgagtataaccggaaacaagttctccgacactgctttacagaatggcagcattggcatggcgccgagctcctgaagagagagctggctctcacaaaagaggaaactaggaagaagatggatgcactgctgcaggcagcatcactggggaaactcagtgccaatgggttatcaggcatcagtctacctgaggaggcaacagccattggtgggtccaccagtaaaaaatggacaggagactgctgtgccccctttgtgggaaaagcctcccttgggaagcagtggttgtatgctcagtcctcccctgggaagaacaacaacaggcaacttgcagggttcccttcagaatgtctctctgagtgcacctggcaataagcagcacaagaccctgggtgctgaaccctctcaacagcctggcagcaacgagacactcagaactaccagccagaaagcagaaccgctttgcttgggtcatttccacaaccgccatgtcttccagcaacagctgattgagaagcaaaagaagaaacttcaggaacagcagaaaacaattctcgagctgaagaaaaacctgcagctggcagaggctcagtgggcagcagagcatgccttagcagtcacagaagcacagagccacctgctgtcaaagcccagagaagaggaaccaagaacctgccagatgcttgtgaattcacctgttgcttcccctgggactgaaggcagaagtgactcccgaaattctctttctggactcagaaggaaaccaaagcaattgatgacaccgcatcccatactaaaagctatggaagagagagcaattcaacgagctgaatgtaggcggatcttggcagagaagaagaaaaaacaagaagaagaaaaattggcccagttaaaggcccaagaggaggaacgtcagaaaagggaggcagaagaaaaggaggcacagcttgaaagaaaacgagaagagaagagactgaagaaaatgaaagaacttgagaagcagaagagaattaagaggaaccagcagctggaagcaatagccaaagaacattatgaaagggtcttgctaaggaaaaaaggtctagagccttggaagagattgagaatgcaaagcaaacaaaacatccaggtggcagaagaacattactctttgttcctgcagaggaaatacatgctgacgtggttccagcgtagtcaggaaagtctggctagaaagatggcccaggctgatcaattttattcccaaatactgcttaagagagtcatccagagctggctacagtacgtgattgatctgcaggaagaagtaagaaaattttgtgtacattttcttcaaaagaagattttcagggcctggtttaacatggtcagggaggtgaagatcgattctcagggcaagcatgagattgcagcggagcacagtgacaggaggatcctctggatcacccttcggacatggaagaagtttgtaaaatttatgaaagaggaaagagtaaaagaagaaaggcgacagcaacttcgtaggaaggtagttgaaattcttccagacttccaggtacctggaaggtaccacgagctatatcagcaatcagatacttggtccttgagtaagacaagtctggtgaacgaatgagccagattagtgtaatatttaggacaggaagctcgactagtctgtatgtgtgttatctccacccacccacacacatacatacatacacctggtttattctctacgagctacttcttagatcaaaggaattattttgagaatttttattcccttctttgacttttcctggattgctagtcattcactatagcatttatcacagtgggatcatccaaaggaacattctagagatcgtctgttcaaatatatcctatatatttttagcatagtaaactttaaaaaggacaagtgtttgcctgactgagcctgtgaagaaaatgtgtccgtatagcacgacaggagttgctgatgtgaccttaatgaaacagaaataaacaggggtgagtgctcggaaaggaagggcgggccaaggcactcagccttctagtgcagtagcatcagtgacacgcaccccaccagacctcgtccactttcaccacccctgaaggcagaccatgtatgaaaaggttctctacacagctgctgcagaggacagcagcttatcctgatttcagagaaactgaggcaccagagatgcttctcttccgtgcaccttgataagcatgaaggacattccaaaaggtaataactctatcatgacagtccagcaattcattaaattatctgttcatgctcccacctgcaactgctgaataatacactcagtttgtcttctagtactcagctcagtttgatctagatattgagatacctatcttgaattcaaagaatgttttcatctttaagatgctataaagactgataaaatgctctcttctatgaattgtgttagagaattacctgctagaaaaataatttttcattataaaatacacatttattatataacaaattcaagtagtccataaatgcatatggtaaaatgagaaagtcctgtgcagtcctgagatgattactcttatttggtgtgctgaaaatttgagttgacaaaataaaattctgtggttttttaagtgaaaaa

SEQ ID NO: 308449 - DNA, 818 bp, Homo sapiens
  misc_feature (734)..(734): n is a, c, g, or t
gagagagagagagagagagagagagagagagagagagagagagagagagagagagagagagagagagaatttaatagcctgtcaagaacaggagtctgacactcaaattcattcagatgccagttctccaaatgcctggtacaattccatttcctgcccatctgtatatccaggccttaaaactagattcaaatatattcatcgtgaccccaaactttagtttgtttgttgttattcttatatatacagacatatgtacagtgacttaagaaaaattagcagattcaataggatttgaggaacgattctactctcaaagtacttgttagatgtaattaaagttttctgcattcatcaaacatataatcaaattagaattctggtttctgggtttcatatactaaaagtatcatcaaggcacattataaatcagtaaacaattattttaataaaaatgtaaacaaaataattaatttataaattgttcctcattgctgaggatgggataataggtctttaacctgtagagtatataagttctgtttatctctatatattttctgagattgtgaacattcaacttacaagaaaaccctaataataacactaaattttactatgaaatggagacatttctcttgcagtattcctcatattttttcaatataaaaaatattagaactctgttactattttctagcttgagaagagaatcacgacgatgaggggttggngaagagaaacaaaagaatgtcggtaggccaaggaggtcaagggcaaggggtttaaacaaagcatcgttcaattcctggtcttgt

SEQ ID NO: 308450 - DNA, 839 bp, Homo sapiens
ctatcctaaacataaaagatcacatttctgttcaaattgagggttctgatatttctgggttctaatctcaatcaggcccagttaaaggcccaagaggaggaacgtcagaaaagggaggcagaagaaaaggaggcacagcttgaaagaaaacgagaagagaagagactgaagaaaatgaaagaacttgagaagcagaagagaattaagaggaaccagcagctggaagcaatagccaaagaacattatgaaagggtcttgctaaggaaaaaaggtctagagccttggaagagattgagaatgcaaagcaaacaaaacatccaggtggcagaagaacattactctttgttcctgcagaggaaatacatgctgacgtggttccagcgtagtcaggaaagtctggctagaaagatggcccaggctgatcaattttattcccaaatactgcttaagagagtcatccagagctggctacaggtaaggacatagggaagggtaccttaaatacatctcattgctcaattctatttaagaaaactaaatgaaatccagaatgtccagggtcattatgttttttcaagaacaaaagagtagtcaatcccattcactgctttgaaataaatgtgaaaatggtaaatcagtgttttattagtgtaaaatcctaagcctgtgtttgtttcacggagtgtgtataaactgtaagttatcattccatcagcttttgtttttatagtcatttcttgtttcttgtctcacagtgctcaagtgatttagaaacttaccccttcaatcttataactgtttctattcatgtgttctcttaccatttttaggatacatta

SEQ ID NO: 308451 - DNA, 628 bp, Homo sapiens
ccttccaacatctcatttcttgaagagactatcctttctccagcgtatactcttggtaactttgtcaaaaatcagttcaccatagatgtataaatttatttctggcttctttattccattccatttgtctatgtgtcttgttttatgccagtaccgtgttcttttggttaccagagccctgtagtgaaatttcaaataaggtaatgtgattcttccagttttgttatttttttttctcagaatggctttggatatttttgttttttttgtgtgtgtggttccatataaatgttaggattagttttttgtttgttttagatttctgtgaagagtgtcattggtattttgttagggattgcctcaaatctgtagtattttggatagtaagaaaattttgtgtacattttcttcaaaagaagattttcagggcctggtttaacatggtcagggaggtgaagatcgattctcagggcaagcatgagattgcagcggagcacagtgacaggtgaggttttgatagtgaggaaaattcactctctgacttcacaattgctcagcaatatattctgctcctacaatgtgtctgcagagatgagctggaggctaggagagcggggaaacaccagtc

SEQ ID NO: 308452 - DNA, 2554 bp, Homo sapiens
gagagagagagagagagagagagagagagagagagagagagagagagagagagagagagagagagagaatttaatagcctgtcaagaacaggagtctgacactcaaattcattcagatgccagttctccaaatgcctggtacaattccatttcctgcccatctgtatatccaggccttaaaactagattcaaatatattcatcgtgaccccaaactttagtttgtttgttgttattcttatatatacagacatatgtacagtgacttaagaaaaattagcagattcaataggatttgaggaacgattctactctcaaagtacttgttagatgtaattaaagttttctgcattcatcaaacatataatcaaattagaattctggtttctgggtttcatatactaaaagtatcatcaaggcacattataaatcagtaaacaattattttaataaaaatgtaaacaaaataattaatttataaattgttcctcattgctgaggatgggataataggtctttaacctgtagagtatataagttctgtttatctctatatattttctgagattgtgaacattcaacttacaagaaaaccctaataataacactaaattttactatgaaatggagacatttctcttgcagtattcctcatattttttcaatataaaaaatattagaactctgttactattttctagctatggaagagagagcaattcaacgagctgaatgtaggcggatcttggcagagaagaagaaaaaacaagaagaagaaaaattggcccagttaaaggcccaagaggaggaacgtcagaaaagggaggcagaagaaaaggaggcacagcttgaaagaaaacgagaagagaagagactgaagaaaatgaaagaacttgagaagcagaagagaattaagaggaaccagcagctggaagcaatagccaaagaacattatgaaagggtcttgctaaggaaaaaaggtctagagccttggaagagattgagaatgcaaagcaaacaaaacatccaggtggcagaagaacattactctttgttcctgcagaggaaatacatgctgacgtggttccagcgtagtcaggaaagtctggctagaaagatggcccaggctgatcaattttattcccaaatactgcttaagagagtcatccagagctggctacagtacgtgattgatctgcaggaagaagtaagaaaattttgtgtacattttcttcaaaagaagattttcagggcctggtttaacatggtcagggaggtgaagatcgattctcagggcaagcatgagattgcagcggagcacagtgacaggaggatcctctggatcacccttcggacatggaagaagtttgtaaaatttatgaaagaggaaagagtaaaagaagaaaggcgacagcaacttcgtaggaaggtagttgaaattcttccagacttccaggtacctggaaggtaccacgagctatatcagcaatcagatacttggtccttgagtaagacaagtctggtgaacgaatgagccagattagtgtaatatttaggacaggaagctcgactagtctgtatgtgtgttatctccacccacccacacacatacatacatacacctggtttattctctacgagctacttcttagatcaaaggaattattttgagaatttttattcccttctttgacttttcctggattgctagtcattcactatagcatttatcacagtgggatcatccaaaggaacattctagagatcgtctgttcaaatatatcctatatatttttagcatagtaaactttaaaaaggacaagtgtttgcctgactgagcctgtgaagaaaatgtgtccgtatagcacgacaggagttgctgatgtgaccttaatgaaacagaaataaacaggggtgagtgctcggaaaggaagggcgggccaaggcactcagccttctagtgcagtagcatcagtgacacgcaccccaccagacctcgtccactttcaccacccctgaaggcagaccatgtatgaaaaggttctctacacagctgctgcagaggacagcagcttatcctgatttcagagaaactgaggcaccagagatgcttctcttccgtgcaccttgataagcatgaaggacattccaaaaggtaataactctatcatgacagtccagcaattcattaaattatctgttcatgctcccacctgcaactgctgaataatacactcagtttgtcttctagtactcagctcagtttgatctagatattgagatacctatcttgaattcaaagaatgttttcatctttaagatgctataaagactgataaaatgctctcttctatgaattgtgttagagaattacctgctagaaaaataatttttcattataaaatacacatttattatataacaaattcaagtagtccataaatgcatatggtaaaatgagaaagtcctgtgcagtcctgagatgattactcttatttggtgtgctgaaaatttgagttgacaaaataaaattctgtggttttttaagtgaaaaa

SEQ ID NO: 308453 - DNA, 2832 bp, Homo sapiens
  misc_feature (1)..(2): n is a, c, g, or t
  misc_feature (4)..(4): n is a, c, g, or t
  misc_feature (7)..(8): n is a, c, g, or t
  misc_feature (11)..(11): n is a, c, g, or t
  misc_feature (13)..(13): n is a, c, g, or t
nnanatnngcntnaaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatagagaagaaaaggcaagaagagaattctcaaaatagttcagaaaaagtcatgtttcaaagtactcacattcttccagatgaggaaaaaatggtgaaggaaagaaaaaggaaattgaaagaagtattaatccaaactttcaaagaaaatcaacagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacagaaaacaacaactggccactgagtataaccggaaacaagttctccgacactgctttacagaatggcagcattggcatggcgccgagctcctgaagagagagctggctctcacaaaagaagaaacttcaggaacagcagaaaacaattctcgagctgaagaaaaacctgcagctggcagaggctcagtgggcagcagagcatgccttagcagtcacagaagcacagagccacctgctgtcaaagcccagagaagaggaaccaagaacctgccagatgcttgtgaattcacctgttgcttcccctgggactgaaggcagaagtgactcccgaaattctctttctggactcagaaggaaaccaaagcaattgatgacaccgcatcccatactaaaagctatggaagagagagcaattcaacgagctgaatgtaggcggatcttggcagagaagaagaaaaaacaagaagaagaaaaattggcccagttaaaggcccaagaggaggaacgtcagaaaagggaggcagaagaaaaggaggcacagcttgaaagaaaacgagaagagaagagactgaagaaaatgaaagaacttgagaagcagaagagaattaagaggaaccagcagctggaagcaatagccaaagaacattatgaaagggtcttgctaaggaaaaaaggtctagagccttggaagagattgagaatgcaaagcaaacaaaacatccaggtggcagaagaacattactctttgttcctgcagaggaaatacatgctgacgtggttccagcgtagtcaggaaagtctggctagaaagatggcccaggctgatcaattttattcccaaatactgcttaagagagtcatccagagctggctacagtacgtgattgatctgcaggaagaagtaagaaaattttgtgtacattttcttcaaaagaagattttcagggcctggtttaacatggtcagggaggtgaagatcgattctcagggcaagcatgagattgcagcggagcacagtgacaggaggatcctctggatcacccttcggacatggaagaagtttgtaaaatttatgaaagaggaaagagtaaaagaagaaaggcgacagcaacttcgtaggaaggtagttgaaattcttccagacttccaggtacctggaaggtaccacgagctatatcagcaatcagatacttggtccttgagtaagacaagtctggtgaacgaatgagccagattagtgtaatatttaggacaggaagctcgactagtctgtatgtgtgttatctccacccacccacacacatacatacatacacctggtttattctctacgagctacttcttagatcaaaggaattattttgagaatttttattcccttctttgacttttcctggattgctagtcattcactatagcatttatcacagtgggatcatccaaaggaacattctagagatcgtctgttcaaatatatcctatatatttttagcatagtaaactttaaaaaggacaagtgtttgcctgactgagcctgtgaagaaaatgtgtccgtatagcacgacaggagttgctgatgtgaccttaatgaaacagaaataaacaggggtgagtgctcggaaaggaagggcgggccaaggcactcagccttctagtgcagtagcatcagtgacacgcaccccaccagacctcgtccactttcaccacccctgaaggcagaccatgtatgaaaaggttctctacacagctgctgcagaggacagcagcttatcctgatttcagagaaactgaggcaccagagatgcttctcttccgtgcaccttgataagcatgaaggacattccaaaaggtaataactctatcatgacagtccagcaattcattaaattatctgttcatgctcccacctgcaactgctgaataatacactcagtttgtcttctagtactcagctcagtttgatctagatattgagatacctatcttgaattcaaagaatgttttcatctttaagatgctataaagactgataaaatgctctcttctatgaattgtgttagagaattacctgctagaaaaataatttttcattataaaatacacatttattatataacaaattcaagtagtccataaatgcatatggtaaaatgagaaagtcctgtgcagtcctgagatgattactcttatttggtgtgctgaaaatttgagttgacaaaataaaattctgtggttttttaagtgaaaaa

SEQ ID NO: 308454 - DNA, 1691 bp, Homo sapiens
  misc_feature (1)..(2): n is a, c, g, or t
  misc_feature (4)..(4): n is a, c, g, or t
  misc_feature (7)..(8): n is a, c, g, or t
  misc_feature (11)..(11): n is a, c, g, or t
  misc_feature (13)..(13): n is a, c, g, or t
nnanatnngcntnaaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatagagaagaaaaggcaagaagagaattctcaaaatagttcagaaaaagtcatgtttcaaagtactcacattcttccagatgaggaaaaaatggtgaaggaaagaaaaaggaaattgaaagaagtattaatccaaactttcaaagaaaatcaacagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacagaaaacaacaactggccactgagtataaccggaaacaagttctccgacactgctttacagaatggcagcattggcatggcgccgagctcctgaagagagagctggctctcacaaaagaggaaactaggaagaagatggatgcactgctgcaggcagcatcactggggaaactcagtgccaatgggttatcaggcatcagtctacctgaggaggcaacagccattggtgggtccaccagtaaaaaatggacaggagactgctgtgccccctttgtgggaaaagcctcccttgggaagcagtggttgtatgctcagtcctcccctgggaagaacaacaacaggcaacttgcagggttcccttcagaatgtctctctgagtgcacctggcaataagcagcacaagaccctgggtgctgaaccctctcaacagcctggcagcaacgagacactcagaactaccagccagaaagcagaaccgctttgcttgggtcatttccacaaccgccatgtcttccagcaacagctgattgagaagcaaaagaagaaacttcaggaacagcagaaaacaattctcgagctgaagaaaaacctgcagctggcagaggctcagtgggcagcagagcatgccttagcagtcacagaagcacagagccacctgctgtcaaagcccagagaagaggaaccaagaacctgccagatgcttgtgaattcacctgttgcttcccctgggactgaaggcagaagtgactcccgaaattctctttctggactcagaaggaaaccaaagcaattgatgacaccgcatcccatactaaaaggcagggctgtcctcggtggtggccttggtggttgttatcttctctcctagagtagaatgtgtacactgggactgaattctggcaactcttgaggttttgagacttggcagaacctgacatcaaaaatctcagaatggtagacatgtgaggagtggagtacaccagagagccccactacttttttcctgccccttttgccaacctttttggcattcccagccaacacacacacaaaaaaacatagctgaaaggtatatcatttttctgtaatttgagatttggattgtgaa

SEQ ID NO: 308455 - DNA, 637 bp, Homo sapiens
  misc_feature (1)..(2): n is a, c, g, or t
  misc_feature (4)..(4): n is a, c, g, or t
  misc_feature (7)..(8): n is a, c, g, or t
  misc_feature (11)..(11): n is a, c, g, or t
  misc_feature (13)..(13): n is a, c, g, or t
nnanatnngcntnaaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatagagaagaaaaggcaagaagagaattctcaaaatagttcagaaaaagtcatgtttcaaagtactcacattcttccagatgaggaaaaaatggtgaaggaaagaaaaaggaaattgaaagaagtattaatccaaactttcaaagaaaatcaacagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacagaaacacactggcactggtatacgaacagtctcgacctgcttacgatgcagca

SEQ ID NO: 308456 - DNA, 327 bp, Homo sapiens
caatccctgatgaaagcaagagagctaacaactattattggttttatatttaaaaactaagttgacagatacagacaaaaggctatacacagggtttcaaatagccatttttagaaagagcatataaaggtttatgttatctaaggtatatactccataatgtatattttaaaataactgaaagagtaaatttcaaatgtctcaccataaaaaatgataggtaaatgaagtgatagacatgttagtttgatttaatcattccacatcatatacatatatcaaaacatcatcacattgtaccccataaatgtatacgataatttttca

SEQ ID NO: 308457 - DNA, 1466 bp, Homo sapiens
tttttttaaaggtgagtacttagtggtagaaaacacaatgattagtagttgatgtcattaccctgatttgagacaaggtgccagattaacccactatcaatgaaaacagtgcaaaaggaaaatcagtataatcttagtataataaagatcttagtattttagtataataaagagaattctgaccatacaaatcccctgaaaggttttcagaaatccccacttcacactttgaaaaccacctctctagaatgatgggttctgttttctctaagaaggtaaggcctgagtagaggatagagaatagtaaagagacaattaactagaaaaaagtagacatacagcacgcagggaagggtctgggtgaagttgaaaaccatgaatttacagtggcaccagtgtgtaatttttttttaaatttttttattctgcagtaatcagaaactgaggcttagtggagagaaaataaatggatgaattcagaactgacgttttcatttggcagaccaaagagtaccacaatttttgcttatatatttgggttacctgtgtattctctatctccccagcttgttgtaagttccctgagggcatgaaccatgcacactttgctcaccatgtctgcccatcaacttccacagagcatcaagtaatgtaggtactttgcaaatatttattaaacatgcataaacaggtctggtatggtggctcaggcctgtaatcccagcactttgggaggctaacgtgggaagatcactggagcccaggagtttggggttgcagtgagctatgactgcaccattgcgtactccagcctgggcaacaaagcaagactgtcttgaaaaaataataaatgaataaataatgatgaataaatgaatgaatccattaataaatcaggaattttagaatggcattgtgataagctgactatataatttaaagcaaacttactgagaacagtttagtgtttgctatggttgcaaggaaaaaaattgattgtatttataatttgtttataggttatttataaaacacttaagcctcttttaatcatggctcccactccagcacaacttgtggacgagaaagggaaaaatgactgaggtttactctcttaccactctgtatgtgtgtgagagaataagagtccacagaaattgctcttttgtactccacgaatatgaggaagtatgagtagaggggaactggtacagaacagaagttattttgggtaagatcaagggcaggatgtaagaaaactagttttcagttacaagggaataaccattgggaatagagctgtgcttcagtgaagtactcaaatggtttaatccagggtaaacctcatgttctgggcagtcgtgccccctgtagtgctttaattcactatgggaaaacatccaatctgtgttttacaaaaaagtactttttggaacccagtacctactagcagagaggacctcctg

SEQ ID NO: 308458 - DNA, 635 bp, Homo sapiens
ggcccggaggaagatgatctcttcagggcgggtgaactcgcggaaggtaggcagcgagatgacggtgtgggagatggtgtgcacggggtcgaacacgcatgtgacatcgttggggcggcaggacttgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttgttcaccaggggaatggctgggatttctcggcactctgcatcatccatcttttcttataggtgggaaaataaacaactttgtgatcctcctga

SEQ ID NO: 308459 - DNA, 2297 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308460 - DNA, 2950 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaagagatcatcttcctccgggccatcacgccaccgcatcctgccagccaggctaacatcatcttcgacatcacggaagggaacctgcgggactcttttgacatcatcaagcgttacatggacggcatgaccgtgggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttggccaatcagattttctatgttctaaggacatggctgctgtagaatagcacagacgtggatgataaattatccccagaagcagcatgacagaatgcctcggggagcacttggaagggaaattgcagttctgttgaaatagaggaaaatcccttggtaaagacacagcctgttaggctcgtgtgggcctccagtatgttcaccaggggaatggctgggatttctcggcactctgcatcatccatcttttcttataggtgggaaaataaacaactttgtgatcctcctga

SEQ ID NO: 308461 - DNA, 2035 bp, Homo sapiens
gtccgttggcagcgcacgttatgaacggactgctcgctgtctcatatgctacgtgaatcctaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308462 - DNA, 1821 bp, Homo sapiens
ggcacgaggggccgccctccccagcagacagcaatggcagcacctcttcacaaatgtggcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308463 - DNA, 1734 bp, Homo sapiens
tacagttgcgactgtgttcacacgccggaaacgtagatcttggatgtcgagtgtgctccagcggacacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308464 - DNA, 2242 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaaggaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308465 - DNA, 1807 bp, Homo sapiens
agaggatccccgttcgctactgtgtggggtagagggaggaatgatggagggtaggagagccttgagcctgcgagaagagtctcctagaatagagaagctgaggttaaagttgtggaagacagtggggataactgagtgacagataatcaggagaagaaaaggagatccagaatcatgacagagagatgacctttgccaagagcacagccatctttcactgtcacagagaggtaggacaaaacgattggtgttcaagaattggtttgtaggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308466 - DNA, 2813 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaagagatcatcttcctccgggccatcacgccaccgcatcctgccagccaggctaacatcatcttcgacatcacggaagggaacctgcgggactcttttgacatcatcaagcgttacatggacggcatgaccgtgggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttgggccacccatttttcctttttcctagggcctgggcggtggtaaaatcgcacaccgttgtatactattttccccccaaacgcactttcacaaattccctgcggggcacctatttgacgggaaattggccttctctgtggaattagagaaaa

SEQ ID NO: 308467 - DNA, 1593 bp, Homo sapiens
gggtgatctagaggatccgcctcgaaagacattaccttgaaagacatcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308468 - DNA, 1515 bp, Homo sapiens
cagcggaaagagcccactgtgttgatgcaggattctccaagccggcagctgtggctgcccgtgatgcattcattgacatcttcacaggagacaccatcagacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308469 - DNA, 2902 bp, Homo sapiens
  misc_feature (2594)..(2594): n is a, c, g, or t
  misc_feature (2596)..(2596): n is a, c, g, or t
  misc_feature (2678)..(2678): n is a, c, g, or t
  misc_feature (2680)..(2680): n is a, c, g, or t
  misc_feature (2799)..(2799): n is a, c, g, or t
  misc_feature (2801)..(2801): n is a, c, g, or t
  misc_feature (2809)..(2809): n is a, c, g, or t
  misc_feature (2833)..(2833): n is a, c, g, or t
  misc_feature (2901)..(2901): n is a, c, g, or t
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaagagatcatcttcctccgggccatcacgccaccgcatcctgccagccaggctaacatcatcttcgacatcacggaagggaacctgcgggactcttttgacatcatcaagcgttacatggacggcatgaccgtgggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctagagagacacacagagagagagaaagagaaagagagacacatatatttntntatagagcgggagacacagacacacagatacacacacaaatagacacacacacagagagagagacacacacagatatacatntngacacacatagagatatagatatatagagatatatatatagagacacatatatatagagacacacatatatatatttttatatatatatatatatagagacacacatatacacagatantntatactantagtatactatatagagaacacanaagactcgactcgtatagagaatatagaagacacgaagagtggagagatgtgagagacacacatctcnc

SEQ ID NO: 308470 - DNA, 2637 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaagagatcatcttcctccgggccatcacgccaccgcatcctgccagccaggctaacatcatcttcgacatcacggaagggaacctgcgggactcttttgacatcatcaagcgttacatggacggcatgaccgtgggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctttcaccaggggaatggctgggatttctcggcactctgcatcatccatcttttcttataggtgggaaaataaacaactttgtgatcctcctga

SEQ ID NO: 308471 - DNA, 3185 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtgaaaaaacaacacaaaaaaacaaaacaaaaaccattgtgtctggaccccactactgggccctctgagaaaaagacccctttcaaaacacccatgcgtctggcggccgccgggggcaccccaataacaggccacatgtcggcaaccaccagggggaccacaaagggcgagttctccacaagaggaaaaaaccccgaggggcaccgaggcaccacaggagcgactgagcgcatcttccccccacgcaagctaacacacacaaaagccgcaccggggagacaaaccgccgaacgccagtctcaagagacaccacgctcccccaaaaatgtggaccaactctccccgagacagcgccacaccaaccacgggcgggacacttccttaacaccgcagcgaaggaagagtccccccacagcagcagaaaagcctacacaaacatcaccagacaaactaattaagcgcgccccaagcctcgacgggggggaacagtcagaaaagagaaccacgacccacagcagcagcggcgacacgtcaacacagccagagccgcgcgacgaccgcggacagagcgcacgcaccagcagatccccgagaggcagcagcacggccggcacgtcacagagcactacgaccgcccacgaccgaactgcccagtagaaacgcaccagcacccccgacacgcgcagcgcgccggagtcgccgcagcacgccgggccaggcgaggagccgccgcgcgacgaccaccccacagcagccgacgagaggcgacgccggagcgcgaagccacagcccgagaccagcgacgggcgcagcacagcgacggcacacacatgctgcaccggcgccgcgcctcgccagcgacacgcccggccaccacccccaccgcccagca

SEQ ID NO: 308472 - DNA, 1385 bp, Homo sapiens
gcttccgctgccgacccaagctacagtgcaaggatcccagagtattctgacagataaaatcggggaggcagttatggaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308473 - DNA, 2278 bp, Homo sapiens
  misc_feature (2201)..(2201): n is a, c, g, or t
  misc_feature (2241)..(2241): n is a, c, g, or t
  misc_feature (2250)..(2250): n is a, c, g, or t
  misc_feature (2266)..(2266): n is a, c, g, or t
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgttcttgcaagagttnttgaggaattcggtttcggtttcgggggggtttttccttncttgtttgntttttcttaaaccttngcctttccgggg

SEQ ID NO: 308474 - DNA, 2181 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagaggtcattctcaacggtgtaagatcc

SEQ ID NO: 308475 - DNA, 2664 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgcagaaatccaagaagggaaggcagaacaccccagcgggatcaagtaaagaggactgcagggttcttccatggaagcaggggttggaggatacccaccttgatgcctagtgaggaagatggacctggacagacagtcagctccacaccttgcgctgagcagctgtgattgtgccacgggagcatgagcccttttccccacggcccttgccactgtctcctggccctctctctgatcatgccaggtttgcaccagcctcgagtctcccatgttgtagtacattctccaagatgcagcccaggagcctctctgaaggaccagtctggttacgatggtctgagcttccttagaaccttccatggttgtcttttcccagcagatgaagcatagcctccttggaatggcatgggaggcctggcctgatctggcctctgcccaccctttgagctgcacctgccccaccccagctcatccatgtgcttgtaccctggccccacggggaggcttgcccttccctgaatctgccttcttgtggctttagcatgtgccatgctgtccccctgcagactgccattctccttgcagacttggctcagaagtcacctcctcagtgcagttagcctgagctcccctggccccaggtgcctccatcagagcatttaccccattgtgttgtggctgttccttaacgtccccactagccaggctctttgagggcagggattgtgtctggttaatttctgtattctctgcaactttgcaatgtttggcttgaagaaggagctcagtaaacatctgaataaacatgcaggttgatgg

SEQ ID NO: 308476 - DNA, 2169 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatctgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308477 - DNA, 2261 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308478 - DNA, 2488 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacatgatcgtagggaactctgcatgaggccatcggtgcaggctggagaagagaaggcaagttggcaggagtggagaccacaggcatttgagccacttcctcatgtaacttaacttgtgccttcaggacctgctcaagcccgatcacgtatataccacttccatttgatgatggaatgctgctgttcatgaccaactttatggctagatgggtcagaaagcacccagttcatgataggcagttcaggtcatatggtgacttgatgacccagagtcaaacattcagtttccaccaaagcccagtaacaggccaagagctgtctctcaaaaggagagtagttatctgcagaagatggcagggccttgctccgaaagcctagagaccgccactgtgattcacctatgggggcctgccaaagctgcagccagcatccttatctgccactgacacctcaagcaacattggatctgctgggtcatatggcccaagtggcagagcaacttgcacaacagcctggacctgtcatagagctttctcctgttctggaccccactcaaaactggcagcctttcaggtcactcaataaatgtgctggagtaacacactcaaacgaggaatgtgttgcctccaaaatccaataggccc

SEQ ID NO: 308479 - DNA, 2456 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaagagatcatcttcctccgggccatcacgccaccgcatcctgccagccaggctaacatcatcttcgacatcacggaagggaacctgcgggactcttttgacatcatcaagcgttacatggacggcatgaccgtgggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtatttcagaggtagatgtctttcagaggta

SEQ ID NO: 308480 - DNA, 2648 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaagagatcatcttcctccgggccatcacgccaccgcatcctgccagccaggctaacatcatcttcgacatcacggaagggaacctgcgggactcttttgacatcatcaagcgttacatggacggcatgaccgtggcccctctcctgaactgtcacattttaaaagatttacagtcatgggaaatgaaaacggtggcatctgccattttggactcggatttatactctgaacactttcaaagcagctgagcaacggacggacagtccctgacctcccctgggcctcagtttccccattgtgaactgggaggagtgggcttcctagtcccttaggcgctggagtccgggaggtcctaaccagaacccacgagcgtgcagtgcgcacagagcagagcgttttggagcctggcctccaggtggcgctgttggaccttggacgctcagtctttgcgcctcaaacccgacggttgttaaaactggcagctggagaaagggaatcgttattcccgtcttgccaaagagccatttatagcacctttacaagcttttaaatgggtttgcatgttgtaaacatgactgagtcactggggggctccccaccccagcctcctcctgcgctagctggcagcaggaataattagttaattacaattaatggtgcat

SEQ ID NO: 308481 - DNA, 2021 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaattaatgaggattaattgctgtttaaacaaaaatgtaattgttcatctttaaattctttccttttcataagaggatcaagctgtaaaaaaacaaaaaaaattaataaaaatttcgag

SEQ ID NO: 308482 - DNA, 2023 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaattttttacccttttttttccccccaaatctattctctcccccgtggtggtcttttcgcatggtccccttatattgcttgaccccggtgacagtatccatatggccattaaccggtggg

SEQ ID NO: 308483 - DNA, 2523 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacggtggaagccttgggcaagctctctgggcctcagtttcctcatctgtaacatgcagatgtcagaacgtgctctgactgagatgcataggtagcaatgtctccatgtcagcccaaagccagggagccgatgtgacctgttggacgttgttgttaggtgcccacctgaaagccagaattcgtccagcctggtgaccgtgtgggaacggcatcaaagattccagatcctaaacgtggggctgcgtgcccctatgtctttgtaagctcactcactcctaggccatcacggcgcccacttgagaccacggttcccacttcctatcccccttgcccctaattgtattcagaaagtctcatttagtgccacagtcagttgcttcaggaaaagctccatgctgggaccgatctcaggactgtggacttgtgacctctcccagcactctgagtgcacgatgcaggcagccagctgtttccgaggccttggccccttgaccttcagcctgccttgggctcttggccagctgcccccgcgacctgagggtcagtggtagtgtccacctcttgaccctaggggcagctgccctggcttgtggcatagcaaggcttctgggtacccgagcagccccgttgtccctggcagccctccatattcttcctggcccgcacatccgtactggctg

SEQ ID NO: 308484 - DNA, 1874 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacgtaagtcccttggaccatgccatcgtcg

SEQ ID NO: 308485 - DNA, 2067 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308486 - DNA, 1749 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaaggtgagcaggagggatgccctggggtcc

SEQ ID NO: 308487 - DNA, 1789 bp, Homo sapiens
  misc_feature (1788)..(1788): n is a, c, g, or t
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacatttatgagtgtgtgacttaatccacagcgctccatccgaagcaataagcggaggtctagagtnt

SEQ ID NO: 308488 - DNA, 1834 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagcgtgtgaccccctgccctacccttaagcctaaggcagtcatatggtttgtaatgtgtctatccggccttgaaaccaaacctctccaggagcgacggacagg

SEQ ID NO: 308489 - DNA, 893 bp, Homo sapiens
gctgacctagaggatccctactctgaaaacatcatcaagcgttacatggacggcatgaccgtgggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttggccaatcagattttctatgttctaaggacatggctgctgtagaatagcacagacgtggatgataaattatccccagaagcagcatgacagaatgcctcggggagcacttggaagggaaattgcagttctgttgaaatagaggaaaatcccttggtaaagacacagcctgttaggctcgtgtgggcctccagtatgttcaccaggggaatggctgggatttctcggcactctgcatcatccatcttttcttataggtgggaaaataaacaactttgtgatcctcctga

SEQ ID NO: 308490 - DNA, 1496 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagagggagcagcaggggccccgtccact

SEQ ID NO: 308491 - DNA, 830 bp, Homo sapiens
ggcccggaggaagatgatctcttcagggcgggtgaactcgcggaaggtaggcagcgagatgacggtgtgggagatggtgtgcacggggtcgaacacgcatgtgacatcgttggggcggcaggacttgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttggccaatcagattttctatgttctaaggacatggctgctgtagaatagcacagacgtggatgataaattatccccagaagcagcatgacagaatgcctcggggagcacttggaagggaaattgcagttctgttgaaatagaggaaaatcccttggtaaagacacagcctgttaggctcgtgtgggcctccagtatgttcaccaggggaatggctgggatttctcggcactctgcatcatccatcttttcttataggtgggaaaataaacaactttgtgatcctcctga

SEQ ID NO: 308492 - DNA, 840 bp, Homo sapiens
ccagtacggatgtgaagcgagaggaaccagacctcatcagcccaacatcaaagacaccatcggaacagcagcgcccgcagcacccaccccgcaccggcgactccatcttcacggccaccccctgcggcggacggttgaccaccagccaccacatcatcccagagctgagctcctccagcgggatgacgccgtccccaccacctccctcttcttctttttcatccttctggctacaggctggccccccatggccgcaactgccaagacattgatgagtgtgtgactggcatccacaactgctccatcaacgagacctgcttcaacatccagggcggcttccgctgcctggccttcgagtgccctgagaactaccgccgctccgcagccacccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtga

SEQ ID NO: 308493 - DNA, 1432 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcgacgagcgcccgcgctaccccggcgcctgtgtagccctccgtgcgagacacgccgctccacctacgcctcccgtccgtgacga

SEQ ID NO: 308494 - DNA, 1406 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcagctacgcccgggcgcctgtgtgcatcgataacaccgtacgagt

SEQ ID NO: 308495 - DNA, 1356 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattggtaagaggtgtgccgccaggattagcgggttattccaggaggggtcagcgacctagccttggggcaggcctctagaatctgcggggccgcatggtatacagaacaggggttggcaaactttttgtgtaaagggctggacagcaaatagagcaaatactttagccgttgtgggccatatggtctctgtcataatagtcaactctgctgttatagtctaaagcggccaagggccatctgtaaacaaatgggtgtggctgtgttccaataaaactttatttacaaaaa

SEQ ID NO: 308496 - DNA, 1242 bp, Homo sapiens
ccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcaaaaaaaaaaaaaaaaaaaaaaaaaaaaaaaaaaaaaaaaaagaaaaaaaagcctggcggcgggacattattgagggggtgggcgaaaaaaaagagagataaaagagggcggcagcagcgggcaccaagacaggtggtccacagaacgcccagtgttgtgctgaacaagggggggaaaaaatagcggggggacccacaaaaggggagagcgcagtataagcgacaaaacacgcgggtgatccgcgggaataaaag

SEQ ID NO: 308497 - DNA, 3995 bp, Homo sapiens
acataacacctctgcagtacttataccatttaatttttgtgttaaatgtctttaaaaataaacaagataacctgccccttacgcctgtcattcagcctggcaggtccttagtgggctagacctacctttctgatgagctgcccgcccccagcgcaagatgattgtttgagaggtaaaaactcttgccaaaaacaacgttaaacttttaatggatgttaacatacttgcatttacaagcagtgaagtttgtcaccttcatgttgttatttatgcagcattaacctttttctccagatcattgagactgaaaatatgatggaccgaattgtgactggcttgtctgagtctagtgtcaaggtgcggttagctgccgtcaggtatgagctttaaatggtctgaataaaaaccttttgccatatatttaacctgttgcctttctggtccttcactgagtaaacacagactacaaatgttcctcaaaaatctgctcaggtgaattcatagagtatataacattgtctaacagagagcctggcctccaaaccccataaagtggtctgatgtagttcacttaacaatgtagatatgcttgaagtgtacattagtcattgtaaaatgccagccagtttgtttgaaaagtaaaagttttgatttcttgtgaagctaattttgattattctttgtagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308498 - DNA, 3158 bp, Homo sapiens
  misc_feature (2149)..(2149): n is a, c, g, or t
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagccttagtctaacactgaactcatgttcttgatgagaatacttctagatgaggagtatagtggtaagtaagctctgacttggctccttccacatanccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaa

SEQ ID NO: 308499 - DNA, 3212 bp, Homo sapiens
  misc_feature (2203)..(2203): n is a, c, g, or t
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcgtttttttaaagaaaaagacgactttcacctttcactatgttgctcttgaaccaggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagccttagtctaacactgaactcatgttcttgatgagaatacttctagatgaggagtatagtggtaagtaagctctgacttggctccttccacatanccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaa

SEQ ID NO: 308500 - DNA, 4185 bp, Homo sapiens
  misc_feature (3176)..(3176): n is a, c, g, or t
gcacgagggcctttggtcttgttgaggatgagcagggactggacgttgtccaggatgaagccaaactcctcgggcctctcggtcaggtctgactggtggtcaggacccagagcgagggcgggcgcctgacaggtcatctcagtagcgttcagaacctcacagatattgatgtgctccttccctccatgcttggcacggatctgggggttctgtatgaggtccaggtgggtcccccatacggcgatgggtgtgtttccactgacaatgctccattctggctcaatccgcacgatggtggggtcttccacatactgaaagaccaggtcctggtggatcttggccctgtccacctgcaccgacaccttcatctctagcacctcatctgaggatgtggtgttgcagacaatgtaggatggagatcgcctgtggaagagacagggctgctttccaaacatcaccaccacgttgcttccggcattcaggttggtgcctgtgatggtcacttgggtccctccggacatgggcccccggctgggcttcagatctgagagagtcagtgtcatgaagtaatagagctgtgaggaccgggccatgaattcaggccgacacacagccacgcagatctccacgaagcctgcatgctggctgggcttggcctcccccatctcacacacgatctgttctgcagggatgtaaccatccactaaagggctgcactccacgccagcaaccttgacatgggaggcgatgtcgcgaaattccaggcccaggttctcccctcggatagtgaccttggtgcccccttcccgggggcctgtcaccgggattatctctgtgatgcgggggtttgtgcacttgcttttggcaccagacagctccagccactggctctcctgggcagggcagtgctggcgcagggtgcactggcctgggccctggcaccagccacatgcgaagtctgggtcagccttgaggcacagcccgcagctctcacgcatggctccacacttgtagaggtgaactttattctgagctgggttgtcaatgttgaagtgcccattccacacgactgtcaactccacgggcaggttgttgatctccatcccttcataggaataagaggtgttctggcactgtacgctggagctgttgaagcgcagggcgggcactcgctgctcgctgccctgaatgttgaggatgcattcgtagccacgctgcccagactggggctgggggaggttcttggccttcagcgtgataggcttgatcacctccacgggcaccaggatcttgtccactcgcagcagctgggggcagtcctcgggcagcttcactcggccttcctggaaggagcaggtcttggggtcatgggtgcagacatgccggcaatccgcatgagcgtcctttcggaccaggaatgaaagttactgggagataacttcgaaggattttgcaacaaattcgagctgtccgactctgagaatgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagccttagtctaacactgaactcatgttcttgatgagaatacttctagatgaggagtatagtggtaagtaagctctgacttggctccttccacatanccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaa

SEQ ID NO: 308501 - DNA, 1018 bp, Homo sapiens
gcggccgcccgcccgccctccaggaagcctcatcccggtctccaccattcccccaagcgtggtgtgcctcctgggcaccaccccctggggtggaccccggctcagtctcgggccagggagtgagcgagggtggagaggcgggatagacgggcagaggggaccgcggccgagccaaagacgtttccaactccgggagctcccgccggtgcgggttcccaggatggcgtctggcaggcggggtggctgggcttatagacaactggctgggcggcgcggcttggactttgccaagcgtttcactgagccttccttttagcgatgccgcttcccgggggccgaacgctctgccttgtgaagcgccgggcttgcagccggcctgagaacgagcgcccactcagctctcccgggctttggcaagaagaggtgcaggctccttggcccccatttcctcagagctgccaggccaagtctgtgcggcttctatcgcgtcccagcacctgggcaccggctgaagcagtttgctttttggcaatggtgattcgtatcagctgcaactcttcctagtgtgtgtggttttttaagcccctttcctccgctctgctcagaggtcgcggctctgagtcagaggaactctatgttccctgtgcctggtattccgtttttctttaaggggagtcaaacattgaaggggggaacaagggggtgagatttatttccccattgttgaaagaagggaacgtattgacatgccaggaagtaaaacctgttttttttttttttaaaacaaagtttttttaaagaaaaagacgactttcacctttcactatgttgctcttgaaccaggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatgtaagtagtatgtatttaagag

SEQ ID NO: 308502 - DNA, 531 bp, Homo sapiens
agcctctttctttgtcattggcctagacagttttcatggcctcgttgcttttgttttgcactgtgccttaaggagacttgattgactgtcattaagataagagatttgactaccttcttgtggaaatattttatattttatcaaatgtactcatggtgcctgagtttcttgttgctgtgttctccttccctaggatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagtaagatgttaaaaattgtggccagatttgtataccttgtttgtgatttctagaaacagacccacatatttttattgtttctttgataattgtgatcaaaagtagtattttatcagtaaaatgttatagggcatcattttagctatagaatgctctttaaaaaa

SEQ ID NO: 308503 - DNA, 4862 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308504 - DNA, 4044 bp, Homo sapiens
cattttttgtttgttcatttatttttacaggttcgaatgcaagcactgaaatgtttctcagttttagcttttgaaaacccccaggtatcgatgaccctggtaaatggtaggctggagctttcagtggcacctacatgatttaattgatgaactttttagatttaaagaatttccttaatcattgttgtttgttttatttctagttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308505 - DNA, 4786 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308506 - DNA, 4709 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308507 - DNA, 5400 bp, Homo sapiens
gcggccgcccgcccgccctccaggaagcctcatcccggtctccaccattcccccaagcgtggtgtgcctcctgggcaccaccccctggggtggaccccggctcagtctcgggccagggagtgagcgagggtggagaggcgggatagacgggcagaggggaccgcggccgagccaaagacgtttccaactccgggagctcccgccggtgcgggttcccaggatggcgtctggcaggcggggtggctgggcttatagacaactggctgggcggcgcggcttggactttgccaagcgtttcactgagccttccttttagcgatgccgcttcccgggggccgaacgctctgccttgtgaagcgccgggcttgcagccggcctgagaacgagcgcccactcagctctcccgggctttggcaagaagaggtgcaggctccttggcccccatttcctcagagctgccaggccaagtctgtgcggcttctatcgcgtcccagcacctgggcaccggctgaagcagtttgctttttggcaatggtgattcgtatcagctgcaactcttcctagtgtgtgtggttttttaagcccctttcctccgctctgctcagaggtcgcggctctgagtcagaggaactctatgttccctgtgcctggtattccgtttttctttaaggggagtcaaacattgaaggggggaacaagggggtgagatttatttccccattgttgaaagaagggaacgtattgacatgccaggaagtaaaacctgttttttttttttttaaaacaaagtttttttaaagaaaaagacgactttcacctttcactatgttgctcttgaaccaggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308508 - DNA, 4785 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308509 - DNA, 4612 bp, Homo sapiens
ggctggtacggccggggtgtcggatggagacccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308510 - DNA, 4916 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcgtttttttaaagaaaaagacgactttcacctttcactatgttgctcttgaaccaggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308511 - DNA, 4768 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaagggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308512 - DNA, 4839 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcgtttttttaaagaaaaagacgactttcacctttcactatgttgctcttgaaccaggaccaggaatgaaagttactgggagataacttcgaaggattttgcaacaaattcgagctgtccgactctgagaatgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308513 - DNA, 4128 bp, Homo sapiens
  misc_feature (1)..(1): n is a, c, g, or t
ncttgtgcaacgactctcttaatctccaccgctacaggatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308514 - DNA, 4693 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctcaacttacatagattttctttatataaaaaaaaagaaaaaaaaagaaaaagttggctatagttggcctgattaacaggcactatacatggtgctgtgcaaaatagtaagctagcatcttactgccgtcaatattagcaggtacagagccttttttcatcctaattcagtaagttctcaggcttccaagtcaaatggagaagtaaagtgaggcaacagattcaccataggctttttgaagcatcaaagggaaatataactactgatagtgaaagcccagccatgacccagatgggcttacccttgacaggaactggggaccaagagcctcccaattgccctaactcctgtcattggtattagcaatatctggccagatttagaaccagtcatggaaacttgtgctcaaactaaaagtaggtcatcacttcccagaaacagaataccttgtgcttcctgaaacagcatatatcactgtgaaactaaagaatattctacagacacccctgtagaaagaaacaaagaacaggatagtttagaaagctttctgttagctgtattcagcaaatttcatactagttgctcaggactgctagttggtatgcttttgtaaaacgagattgaaatttaataaaagatgcaactaaaatctttcctgcatgaagctaaaagcactcaagttgagagaggggcaagggaatctccccaggatgactgaagatgacttctttttacagcaagtactgttagcctttctgcaccccttagcttggcccctgctccaacttctgggtcagcagcaaggtgaactcaacagaagttgctcttgactgtttgaaggtagaagcagcctaccttttctctttgctaaaagaaggtcaaaggcttcgcaaccaggatgcaaggtctgcggtccagaagcttgcggtgagtgtgtgccactgatggagctccaagcccacccaccagccactcctgatggggttgctcacactgcagctgccctatcaccaccctgcacgttccttggaagatttaaatgtttggttgcaaatgaatgttttaaaaatgtatttaatgcaatttttcctgctctcaacatgaccacccaagattcaaacacagagacttccaagttactattttttcagaacatcaccgattttaaaatctgtcacaacaggacttggttttgtgcagatatcagagtgctaatgtgagaaacccagttaaaagaaaacttagtttattgggaagaaagcctcaggcccactcgtttctagaactgtgaaaatatccttggttggcatttttaacacaaaacactatagtgttggtattaaatagtactaggtaaatataaagaaaccaataatgaattgctgagacaatcttgaacccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaaagaaaa

SEQ ID NO: 308515 - DNA, 2907 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatgagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaagatcattgagactgaaaatatgatggaccgaattgtgactggcttgtctgagtctagtgtcaaggtgcggttagctgccgtcagatgtttgcacagtttatccagatctgtgcagcagcttcgaaccagtttccaggatcatgctgtttggaaacctttaatgaaggttttacaaaatgcaccagatgaaatcctagtggtagcatcttccatgctgtgtaatcttcttcttgaattttctccaagcaaagagccaattttggaatcaggagccgtagagctactttgtggattaactcagagtgaaaatcctgctttacgagtgaatggaatttgggctttaatgaatatggcatttcaggctgaacaaaaaataaaagcagatattttacgaagcttgagtactgaacagctattccggttattatcagattcagatttgaatgtgctgatgaagacattgggacttcttagaaatctcctctccactcgtcctcatatagataaaataatgagtactcatggaaagcaaattatgcaagccgtcactcttattctagaaggggaacataacattgaggtcaaagagcagacactgtgcatcttagccaacatagcggatgggacaacagcaaaagatcttattatgaccaatgatgatatcctacagaaaatcaagtattacatgggccattcacatgttaaactgcagcttgcagccatgttttgtatatcaaacctcatatggaatgaagaggaaggttcacaagaacgccaggataaattacgagacatgggcatcgtagatattctacacaaactgagtcagtcaccagattcaaacctttgtgacaaggcaaagatggcactgcagcagtacctggcatgatgggagtgcccctgggcacctgcgagcatcccacctccttgtttaaggaagtacaggaaccagcctcatttgattccttctatttgcacaagtcaccttggactgcagggagctgttttgcaaaagcagtttagtaggcttagatctcaaattcatcttgagaacatttttttgaggtagtaatttcctcagaagactcttgtgttttgttttggtttttttttctgagctactcggactctttattagaacaatcaatcattttcctttggacctacaatttttgcctatgctgcagccactttgtgagtgagaatgaatatgtctgtgtgaacacacaggcatgcgtgtgtatgtgcacgtacatgggccagaatgaatggatgtgtgtgtgtgagggatacctcagatttttcttttcttattttgtgtgaaaatctcttttctacagattttccagggtttaagcattgcttgctgtataaaaaactttactgaattatatacagtttgaatgaaatgttattttaaaaacaaaacaattgttaagtgttccataaaggttatgttgaattttggtcagatgaatatttgtaagtaaaaaatatatgcatttctgaacctca

SEQ ID NO: 308516 - DNA, 2003 bp, Homo sapiens
  misc_feature (1953)..(1953): n is a, c, g, or t
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaangatcggccggccgcaatcctctgattatattaggtatttttaagaaataa

SEQ ID NO: 308517 - DNA, 2004 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaccggtatgcgacgaggcccccctcttttttcgttgtgggagactaaagagca

SEQ ID NO: 308518 - DNA, 2001 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaatcctgatgcggcaagaaccatcttcataatctaataatattaaatatat

SEQ ID NO: 308519 - DNA, 2424 bp, Homo sapiens
  misc_feature (1)..(1): n is a, c, g, or t
  misc_feature (1415)..(1415): n is a, c, g, or t
ncttgtgcaacgactctcttaatctccaccgctacaggatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagccttagtctaacactgaactcatgttcttgatgagaatacttctagatgaggagtatagtggtaagtaagctctgacttggctccttccacatanccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaa

SEQ ID NO: 308520 - DNA, 2021 bp, Homo sapiens
  misc_feature (1955)..(1955): n is a, c, g, or t
  misc_feature (1963)..(1963): n is a, c, g, or t
  misc_feature (1997)..(1997): n is a, c, g, or t
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaatancgatgcgnccaggttttttctttatttttaaatttttttttntttttttttttttttttttttttt

SEQ ID NO: 308521 - DNA, 2007 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaacgatggcgtgcggccccatcataatataatggactatatacatcaagtcactgat

SEQ ID NO: 308522 - DNA, 2008 bp, Homo sapiens
  misc_feature (1969)..(1969): n is a, c, g, or t
  misc_feature (1977)..(1977): n is a, c, g, or t
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaactggataaagaaaggcncccttttnttgtggactaatttagaaaagcgaatatcga

SEQ ID NO: 308523 - DNA, 2428 bp, Homo sapiens
  misc_feature (1)..(1): n is a, c, g, or t
  misc_feature (1419)..(1419): n is a, c, g, or t
nttttgtaagtgacttgactctctaattaccaccgctacaggatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagccttagtctaacactgaactcatgttcttgatgagaatacttctagatgaggagtatagtggtaagtaagctctgacttggctccttccacatanccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaa

SEQ ID NO: 308524 - DNA, 2013 bp, Homo sapiens
  misc_feature (1974)..(1974): n is a, c, g, or t
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaatgcgtcacacgagaggccctcnttttgtctgcgggtcaaatagggtgcggggtatgcggaa

SEQ ID NO: 308525 - DNA, 2007 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaccaatgattcgttagaacataaaagagaaacgatcagcgggcgtccgagacgtat

SEQ ID NO: 308526 - DNA, 2005 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaatttgagttcgcccgaaggcggccttttttttgtcccccccaccccggcgtgaa

SEQ ID NO: 308527 - DNA, 1950 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctaacgaacccgctctctgatatcgggcttatttgattgtcttcaatgttcctagaaacatgcccacgtttacatgtaat

SEQ ID NO: 308528 - DNA, 1718 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgttttggttgatggagaattgttaccacagatttttgtgaagatgttacagagggataagcctattgagatgcagctcacatcagcaaaatgtttaacttacatgtgtagagctggagcaattcggacagatgataactgtattgtattaaagacattaccttgtttggttcgaatgtgcagtaaggagagattactagaggagagagttgaaggagctgagacacttgcctatctgattgaaccagatgttgagctacagagaatcgctagcataactgatcacctcattgccatgcttgctgattatttcaagtatcccagctcagtgagtgccatcactgatattaaaaggcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctgcgtcgacgcgccctcgcatttagtagtagtagtatcgacc

SEQ ID NO: 308529 - DNA, 2224 bp, Homo sapiens
  misc_feature (1215)..(1215): n is a, c, g, or t
ggacgcgtgggtcgacccacgcgtcggcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagttcgaatgcaagcactgaaatgtttctcagttttagcttttgaaaacccccaggtatcgatgaccctggtaaatgtttaacttacatgtgtagagctggagcaattcggacagatgataactgtattgtattaaagcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagccttagtctaacactgaactcatgttcttgatgagaatacttctagatgaggagtatagtggtaagtaagctctgacttggctccttccacatanccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaa

SEQ ID NO: 308530 - DNA, 1849 bp, Homo sapiens
  misc_feature (840)..(840): n is a, c, g, or t
cagttaatgttattgaaagttgaatttatggactgagttggaacatatcctttttttccccatagcttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagccttagtctaacactgaactcatgttcttgatgagaatacttctagatgaggagtatagtggtaagtaagctctgacttggctccttccacatanccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaa

SEQ ID NO: 308531 - DNA, 1983 bp, Homo sapiens
  misc_feature (974)..(974): n is a, c, g, or t
aatctcatttctgttaataggactactgtccccagacctgaagtttattgaagcttgcctccgatgcctgcgtaccatcttcaccagtcctgtcactccagaggagctactgtatacagggccagatcatcaaacaattttatttaaccacggtgcagttcagaatattgctcacctactaacctcactgtcctacaaacttgatcatgatttaaaacatgctcacgaactccgccaggctgcattcaagctctatgcctctcttggagcaaatgatgaagacatccggaagaaggtgagtctgggagaggggcgtcccccagtcctgacagccagcaggcagggagtgacgtcaacctgaaagtcgtggtgaagagcactaacagtgactgtttgaatataataaagcagagtgactaaaggcataattgaagaatgaatgggacccggatttggggggttgtttgtttgtttttagaacatagagtggcatggccgtgctggaatgacaaataactggcgtgctttttttttgtgtcattaatatgaattattatgttgcacatttttgcatgtgttctgataaaaatcaattctagcactgtgaagcttcagacaccttgaaagtcctaacattagaattgtaaatgttatttatggaaataccttccaatgctattgagaaattcaaatctctattgtatattgttctttgatatgtggcttagttttatgttttgattttttttgctactgtgcaagtttaatgtgaataaaatctttgtggaatgatgattttatgtttagtgagtggtcatctgaattttccagctccccagaaaatgtatgcactggtatagcacccttatgttactaaagccttagtctaacactgaactcatgttcttgatgagaatacttctagatgaggagtatagtggtaagtaagctctgacttggctccttccacatanccaaaaagctggaacttaccactcaaaaacatgtataacctaataaattctacacaaggctttcaagaccatcagagagcaaaaccacatgttctgtcttgaggagccatagcagaaagagcaaattagtcattatttactgaacatgatgatttactaaatctctccatctgcattagtattttaaggagcactgtgagagaaatcacaaagtattagagtttaccatgattcagagaagttcttcaggcctgtagaaagaggagtatggaacaaccttacatttgttgaaataacttgaaaaggaaccatttcttgaagaaactgaagtaatagcaataagatttgatgtgtgagtagctttgatttaaaatcaatgcaaaaagcacaactaataaattgaatgtttccatgtacctcactttatttcagttaacaagatactttgacttgaagtgtttttagtgtatccctatgaaaatcatttttggtacatctaagttttcacttataaactgttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaa

SEQ ID NO: 308532 - DNA, 1109 bp, Homo sapiens
agcggcgcttccacctctaacccaggctcagagtagctgctgtttctgagagaacgattcgtaggacagcccctgacgccattcccttttgcccttctttctgcgggcctttccggtacttgagcggtgtccagagcgtggccagttctcgtctatctggctgcctttagggagcggtgcctagcgttggccaatagttggctgtcgaaagtgccggcccccgcgccggcgcctgcagcagccgggtgggaaggctcaagatggcgtgcttgttggagaccccaatccgcatgagcgtcctttcggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagggccagatcatcaaacaattttatttaaccacggtgcagttcagaatattgctcacctactaacctcactgtcctacaaagtaagatgttaaaaattgtggccagatttgtataccttgtttgtgatttctagaaacagacccacatatttttattgtttctttgataattgtgatcaaaagtagtattttatcagtaaaatgttatagggcatcattttagctatagaatgctctttaaaaaa

SEQ ID NO: 308533 - DNA, 1944 bp, Homo sapiens
gcggccgcccgcccgccctccaggaagcctcatcccggtctccaccattcccccaagcgtggtgtgcctcctgggcaccaccccctggggtggaccccggctcagtctcgggccagggagtgagcgagggtggagaggcgggatagacgggcagaggggaccgcggccgagccaaagacgtttccaactccgggagctcccgccggtgcgggttcccaggatggcgtctggcaggcggggtggctgggcttatagacaactggctgggcggcgcggcttggactttgccaagcgtttcactgagccttccttttagcgatgccgcttcccgggggccgaacgctctgccttgtgaagcgccgggcttgcagccggcctgagaacgagcgcccactcagctctcccgggctttggcaagaagaggtgcaggctccttggcccccatttcctcagagctgccaggccaagtctgtgcggcttctatcgcgtcccagcacctgggcaccggctgaagcagtttgctttttggcaatggtgattcgtatcagctgcaactcttcctagtgtgtgtggttttttaagcccctttcctccgctctgctcagaggtcgcggctctgagtcagaggaactctatgttccctgtgcctggtattccgtttttctttaaggggagtcaaacattgaaggggggaacaagggggtgagatttatttccccattgttgaaagaagggaacgtattgacatgccaggaagtaaaacctgttttttttttttttaaaacaaagtttttttaaagaaaaagacgactttcacctttcactatgttgctcttgaaccaggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagatgccacagtgataccacacctcatggcactgcttagcaggtcccgctatacccaggagtacatctgtcagatcttctcacactgctgtaaagtaagaaccagaataaatgttatctataatgtaaaatcttattatgcctttaagagatgtaccttctttgtgtaccctcccaggggtagtcatacatatataagtagacctgtgtgtgtgcgtgtatatatatatatatatatatatatatatatatatatatgtatatgtatatgtatatataaaatatatatatatttaaaacacaaatgacagcataccatacatactgttctgcaccttaacatttttcacttgacatatctctaaggctattccatatcagtacataaggacctctccctcattctttttttttttttttaacagtgcatagtattttagtgtgtagatttatttgtccagtcctctattgtggagcatttagtttgtttccagtcttatgctattacaaaacagtgctgcaaaaaataccttgtatatgaggcattttataagaaataaaattttggggtcaaagaatatatgtatttgtaattttaccacatttttaaataaagattataccactttatactacc

SEQ ID NO: 308534 - DNA, 1528 bp, Homo sapiens
gcggccgcccgcccgccctccaggaagcctcatcccggtctccaccattcccccaagcgtggtgtgcctcctgggcaccaccccctggggtggaccccggctcagtctcgggccagggagtgagcgagggtggagaggcgggatagacgggcagaggggaccgcggccgagccaaagacgtttccaactccgggagctcccgccggtgcgggttcccaggatggcgtctggcaggcggggtggctgggcttatagacaactggctgggcggcgcggcttggactttgccaagcgtttcactgagccttccttttagcgatgccgcttcccgggggccgaacgctctgccttgtgaagcgccgggcttgcagccggcctgagaacgagcgcccactcagctctcccgggctttggcaagaagaggtgcaggctccttggcccccatttcctcagagctgccaggccaagtctgtgcggcttctatcgcgtcccagcacctgggcaccggctgaagcagtttgctttttggcaatggtgattcgtatcagctgcaactcttcctagtgtgtgtggttttttaagcccctttcctccgctctgctcagaggtcgcggctctgagtcagaggaactctatgttccctgtgcctggtattccgtttttctttaaggggagtcaaacattgaaggggggaacaagggggtgagatttatttccccattgttgaaagaagggaacgtattgacatgccaggaagtaaaacctgttttttttttttttaaaacaaagtttttttaaagaaaaagacgactttcacctttcactatgttgctcttgaaccaggaccaggaatgaaagttactgggagataacttcgaaggattttgcaacaaattcgagctgtccgactctgagaatggaagtaacagctagcagtcgccactatgttgacaggctatttgaccctgatccccagaaagttctacaaggtgtcatagacatgaaaaatgctgtaattggaaacaacaagcagaaagccaatctcattgttttaggagctgttccaagattgttgtacttgcttcagcaagaaacctcaagcacagagctgaaaactgaatgtgcagtggtgttgggaagtcttgctatgggtactgaaaacaatgtcaagtctctactggactgccatattatccctgccttattgcaaggactactgtccccagacctgaagtttattgaagcttgcctccgatgcctgcgtaccatcttcaccagtcctgtcactccagaggagctactgtatacagtgagttttagatgtatttgagacattagttacatttccaccaccagcgtactcttaatttgcttagcatcttcagcttcatcataactgtgttatgtaaaaaagtctcagttggtcatgtgggctcaccccagtatcccagtgctttgggaggctgaggtgggaggattgcttgaggcccaggagttcaagatcaaccagagtgacataacaagactc

SEQ ID NO: 308535 - DNA, 4253 bp, Homo sapiens
actgataagctttttctcactgacattgtaacgcatgactgctaatcagagagaaaaagaaggggaagggaattggggaggaaaaaaaatcagaaggaagacgaaagatggggctataaaaacaaaactacctgatagttgaaacgctttcagagttgttcaaatcagtgagagtggcaacggaacacacaaacaactaattatggaactctactctggggatcctctctggctagataacctgtgctgatgtgcagacacgtggacatccccctctgagactggcggtccagaggcagtctctgccaggcagcattacccgctccgaggtggagcctcagcccccttcttagagctgttaagtctaaggtgtggcagagcagacagagatagaggcatctgaagtgagtataggttttttgactaagaaaaaaaacaacagcaaacatgactagtgatcttgaaatattttgtaccgagagaaagactgcatttatttgtagaatttatcaggtttctgataccactcattggatgtaaacatttcatgtttcctcacttttgatatgaaagtcggtaaaatgcagtattagtcccgggaggatgtgcacagctggtcagagcttccagaaggaatatcttccgaggactaaggtgatcaggttaagagggttcaacatcccacggccctcaccttcctccctcccacattccaggcatggagatatctggtttcagagtcagccccaaatctcctgcctataattactttaactggggtctctaaggttcccacttgagggctaaaatgtagttgggaaagagggcctactggggaggtctcacaggaggcagtgccctgggaaatgccaagtccagactcagtgccaagcagtaaccatctgcactcggggacagcgaggagctgaccgtggcctctgatgaccagcaggtattagatggaagtgaatgagagagagagagagagagtatgtgtgtgtgtgtgtatgtgtgtgttcgaacacatatgattgccagtatggagaatgaaagattaataatgctttctggagagtttgatgcaaaagtgggggaaacggagaaaaggcgctaaggctaaatccatctgcatttgctatatttcattagctaaagtcaggtcagggcagggccaaggcctccaattggcaaaggacagtgttatggctttaaaaagctgaaaccccaacctctaagtagatcacaatgttttctgagctttgcagtaattttctatggaaactaaaacctctaaaacatacaagctggcccaaatgagaacacaagcaaaagatgtggaagacagcaaaacctgagcactggtttgaaccaggcactgacatttgaaatgctttaagccttttcacattccttctttattccctccaaaaaaaaaagtcttgagtttaatttaggtctattttggctgagattagcatacctctgactcacaggatttaataaattatagtattattgaatacataggacatccctctaccccagcttactcttatctttttaatttaaaatagtattctgctaccaagaaggatgcaactgctagttttagatgtaaatagtgttatttactggactttgtgatattattttcttaactacactttactatggccctgttgaaaacagactatcaagttttttgtctctgttctgtcatctctcttaagccaggcacctttagagtgtttgcaatttgttcgaagtggttgaggatctcaggccctgctcacgtgaggtggagtgcaggggagctaccggtttccctgctgacctgctgaatgctaccttcccctcgagttgaatacaccttaaggaaaatgataacacgagggacgtgtaacttgttttgaagcattaaaaaccagcagctcttcactatgttccatattttaaccaaactactgtagactactaaacatagccaagccagaacattccttctggattaagcctaggccacttgaggggcagccaggggtgatggtgtcaggtgagaatcctgtgtcttgaaggagtggcctttacaggaagagtgcccatgttttcacctgcagcgttgccaccagagtgtgcaatacctcctgcacacaggctcagggtaaactgctccaaagctgggttttgtgttgcatacaaagtcaataaaatagttgctaatcctgaatggcagccagtgatgtgaaggtactattaaagtgaacaaaaactagattgcaacagttttctttccttgcttgaagtataacacacgctccatttgatcctgcctgaaagaagctaacattatatttgtgacagacagaggctccatcaagccaagcaacaattaacagctcaagtgtaagatttataaatgcccgtgtactcacccttcaattgttaccacccagaggttacaggactctttcccagcatttaggggaacaggcttttagagtatttagaagaccaggctataatcagtaatgtgcctgggagcaggaaatagctcccaatttatttatggccttgggaaaactcaatccggtgtctccttgtagctcagaacactaatagcccccctggaagagagtggcacattgagctccaaacccaatcaacatacatccacttggctgcagatctgactgctgggtcatgaaggccgtgaaatgatgtttgccctcaagtcactagatattttaagaagccctatttttctccctttttgcaggagtagagagatgaaagaggacagaccattgaaaacttttagatgcaggagaattgagacttccacaagggagagaaacacagcctccccagaatccattatgccatcgggttgtggcactctcacccttgccataataccgtttcctaacaatatcaaatcagtggatgaaatacaagctcagaaacaggaacattttcctaaatcataacctaatagcaaacaaaaattgaaaaaacaattattctgaagctcattattcttagatctgtagatatatatgtgttgactcccacaggatggcaccaagtaaagatcttaagagcatagtaggggttctgagaccgactgtcacccgtggatcctgatggggaagaacagaggcttcactgtagctatagttttccaccaagtcaatcaaattaaaacatgactcattgtcccctccaaagattcataaaattcttgagctaaagtgatcttctgaagaaaagccacctaacaatgttaggaggctcataaagctcatttctcttttccctggtatgcacaaatatcaagcctataaaaaagtaattatttccccaaacctgtaaccactgcattcgttttctttggaggaacattgtagcatttcaggagggtcgagagatctaaagagtttggtctgaatgtgtgtctgtacaattccctttggcattaaactctgaaacctacaatcaatggccttcaaattggtgttaaattgggagaacaccctactgctttctgagtctacgagcaacagaaagactggtcttagtgcaattaggcaggagggatttggactcagaaacagccacagaagtatttctcagcactcccagttcctgccaacttagctggaaacgatgccacagcgagaccagaaagaggagtcgccttaaggtatccctacaaagtcacctttctgataaaaaggagggaaaaaaaagttagatatctaaaataagcctagaatctcacacacagctgtgacttctaagtgaaactcttttctccctcatgtccttaaatagtcacagaatcacacacagcctgacttttaaagacaagcttggctacaggaaatgaaccaaccccaaagactcttctaacctgtctcctgactgggctccttcagaaagtgttctcctgttccatctgtagggctgcttactactggaacctaaaacaaaacctgttgtttgtaccatcactttttctggtgtttcctgtgcttttgtgattccaagtctgttcataagttctgaagataaattatgtgaaatcatattttggcatatgggggtggaggatgaattctttacagactttttaagatgatccatttgtaccacagaaaacattttggaagttgttatatatgagtatataaatttttcttttcatattttacattaaaataaagctttattcagtcattaaaaaaaaaaag

SEQ ID NO: 308536 - DNA, 4199 bp, Homo sapiens
actgataagctttttctcactgacattgtaacgcatgactgctaatcagagagaaaaagaaggggaagggaattggggaggaaaaaaaatcagaaggaagacgaaagatggggctataaaaacaaaactacctgatagttgaaacgctttcagagttgttcaaatcagtgagagtggcaacggaacacacaaacaactaattatggaactctactctggggatcctctctggctagataacctgtgctgatgtgcagacacgtggacatccccctctgagactggcggtccagaggcagtctctgccaggcagcattacccgctccgaggtggagcctcagcccccttcttagagctgttaagtctaaggtgtggcagagcagacagagatagaggcatctgaagtgagtataggttttttgactaagaaaaaaaacaacagcaaacatgactagtgatcttgaaatattttgtaccgagagaaagactgcatttatttgtagaatttatcaggtttctgataccactcattggatgtaaacatttcatgtttcctcacttttgatatgaaagtcggtaaaatgcagtattagtcccgggaggatgtgcacagctggtcagagcttccagaaggaatatcttccgaggactaaggtgatcaggttaagagggttcaacatcccacggccctcaccttcctccctcccacattccaggcatggagatatctggtttcagagtcagccccaaatctcctgcctataattactttaactggggtctctaaggttcccacttgagggctaaaatgtagttgggaaagagggcctactggggaggtctcacaggaggcagtgccctgggaaatgccaagtccagactcagtgccaagcagtaaccatctgcactcggggacagcgaggagctgaccgtggcctctgatgaccagcaggtattagatggaagtgaatgagagagagagagagagagtatgtgtgtgtgtgtgtatgtgtgtgttcgaacacatatgattgccagtatggagaatgaaagattaataatgctttctggagagtttgatgcaaaagtgggggaaacggagaaaaggcgctaaggctaaatccatctgcatttgctatatttcattagctaaagtcaggtcagggcagggccaaggcctccaattggcaaaggacagtgttatggctttaaaaagctgaaaccccaacctctaagtagatcacaatgttttctgagctttgcagtaattttctatggaaactaaaacctctaaaacatacaagctggcccaaatgagaacacaagcaaaagatgtggaagacagcaaaacctgagcactggtttgaaccaggcactgacatttgaaatgctttaagccttttcacattccttctttattccctccaaaaaaaaaagtcttgagtttaatttaggtctattttggctgagattagcatacctctgactcacaggatttaataaattatagtattattgaatacataggacatccctctaccccagcttactcttatctttttaatttaaaatagtattctgctaccaagaaggatgcaactgctagttttagatgtaaatagtgttatttactggactttgtgatattattttcttaactacactttactatggccctgttgaaaacagactatcaagttttttgtctctgttctgtcatctctcttaagccaggcacctttagagtgtttgcaatttgttcgaagtggttgaggatctcaggccctgctcacgtgaggtggagtgcaggggagctaccggtttccctgctgacctgctgaatgctaccttcccctcgagttgaatacaccttaaggaaaatgataacacgagggacgtgtaacttgttttgaagcattaaaaaccagcagctcttcactatgttccatattttaaccaaactactgtagactactaaacatagccaagccagaacattccttctggattaagcctaggccacttgaggggcagccaggggtgatggtgtcaggtgagaatcctgtgtcttgaaggagtggcctttacaggaagagtgcccatgttttcacctgcagcgttgccaccagagtgtgcaatacctcctgcacacaggctcagggtaaactgctccaaagctgggttttgtgttgcatacaaagtcaataaaatagttgctaatcctgaatggcagccagtgatgtgaaggtactattaaagtgaacaaaaactagattgcaacagttttctttccttgcttgaagtataacacacgctccatttgatcctgcctgaaagaagctaacattatatttgtgacagacagaggctccatcaagccaagcaacaattaacagctcaagtgtaagatttataaatgcccgtgtactcacccttcaattgttaccacccagaggttacaggactctttcccagcatttaggggaacaggcttttagagtatttagaagaccaggctataatcagtaatgtgcctgggagcaggaaatagctcccaatttatttatggccttgggaaaactcaatccggtgtctccttgtagctcagaacactaatagcccccctggaagagagtggcacattgagctccaaacccaatcaacatacatccacttggctgcagatctgactgctgggtcatgaaggccgtgaaatgatgtttgccctcaagtcactagatattttaagaagccctatttttctccctttttgcaggagtagagagatgaaagaggacagaccattgtccccagaatccattatgccatcgggttgtggcactctcacccttgccataataccgtttcctaacaatatcaaatcagtggatgaaatacaagctcagaaacaggaacattttcctaaatcataacctaatagcaaacaaaaattgaaaaaacaattattctgaagctcattattcttagatctgtagatatatatgtgttgactcccacaggatggcaccaagtaaagatcttaagagcatagtaggggttctgagaccgactgtcacccgtggatcctgatggggaagaacagaggcttcactgtagctatagttttccaccaagtcaatcaaattaaaacatgactcattgtcccctccaaagattcataaaattcttgagctaaagtgatcttctgaagaaaagccacctaacaatgttaggaggctcataaagctcatttctcttttccctggtatgcacaaatatcaagcctataaaaaagtaattatttccccaaacctgtaaccactgcattcgttttctttggaggaacattgtagcatttcaggagggtcgagagatctaaagagtttggtctgaatgtgtgtctgtacaattccctttggcattaaactctgaaacctacaatcaatggccttcaaattggtgttaaattgggagaacaccctactgctttctgagtctacgagcaacagaaagactggtcttagtgcaattaggcaggagggatttggactcagaaacagccacagaagtatttctcagcactcccagttcctgccaacttagctggaaacgatgccacagcgagaccagaaagaggagtcgccttaaggtatccctacaaagtcacctttctgataaaaaggagggaaaaaaaagttagatatctaaaataagcctagaatctcacacacagctgtgacttctaagtgaaactcttttctccctcatgtccttaaatagtcacagaatcacacacagcctgacttttaaagacaagcttggctacaggaaatgaaccaaccccaaagactcttctaacctgtctcctgactgggctccttcagaaagtgttctcctgttccatctgtagggctgcttactactggaacctaaaacaaaacctgttgtttgtaccatcactttttctggtgtttcctgtgcttttgtgattccaagtctgttcataagttctgaagataaattatgtgaaatcatattttggcatatgggggtggaggatgaattctttacagactttttaagatgatccatttgtaccacagaaaacattttggaagttgttatatatgagtatataaatttttcttttcatattttacattaaaataaagctttattcagtcattaaaaaaaaaaag

SEQ ID NO: 308537 - DNA, 3816 bp, Homo sapiens
ttatactttcaggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaagtgttgatcattgttgtcttggtattgcaaactttaaaattgtttcttaccatattgcctcttctctttgagctctgtgggatcacctttaacattcagagatgatagagtggttccccactgagaagccaaaacaaggcccttaataaccccttaagttcaccatatgaatcagaaggagaacactaaagtggagagacttttaagagatcatgatagtgaaagccttaatataatcagaattgtaccataaccttgaatctatatttgttcaaaacatccctttgacttttctaagtgtttgcttaagcagagtgtaagaatgtgtggttacctttggttgagatcctttccattctttttgactctctgcttcagattttttcagtagtgtgagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtactgtctaaaacaatacttttttaaaaaaaaggaacagttgggagaaaataaatataatgaaaaattcccagaggctagcacttggattctaacacgtatgctattgtattatccattagttctgtaatatttaattttagattcttttatttttttaattggcaaagcacaaggtgctgtataacagtgtcatttagagttttatagaaagcttcaacctgagttctgcgttataaagcctggagaaagctaagcttagaacataacttgctgaagtataattatctttttgtagcaggaatttatgtgccagaggtgagagtctttctggtactgattttttgagaccaaggataaaaggatcgttttgtaagacatgccatggcaatggctggttgggggacagtttccgcccaagcttggcctattttatttttcctcatacctactttcaaagtcatttaggtatttgaagccttatttcccacgtagtaacactttctggcttttgcagtttctttttttgtttggttttgttttttgcatggaatggggatcaaacaacccgaagaagaacacattttgatcaagcaaaatgtttgcttcaaatttcagaagtttattttacagaaattaaattaagtagtttgacatccttttctctgtttcacacatatattaggttggtgcataagtaattgtggtttttgccatgacttttatggcaaaacctgcaattacttttgcaccaacttaatacatctatatacatatatatatacgcgcacacacttgttcagaagttatgttgtggccttggatttgtttttccccttggaaatggttcttaactctgggattttagaaggttagaatattttttcaagagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagtctctgattagccagagtatagtatgagtcttcactgagaaatatggtgacccattttctttgtgaaaacctgggaaaatgcaagtgtgggtatgaagtgtgtgttctgtttgcattgaaacaatgtaattttgtgtcttctttttgctttaactgacttatttcagaaattgtacagtgttgagggggaaagtcttttctgttaatatatttgcaattcattaaaggatatggaaaatccaaataagttacttttgaaagcaatttataatcaagttgttaaagctatatgaaagctgtgccatctgtattttaataagaaggcacagaaaaacagagatacagttttatgtttcacaaaaaactagagcaatgtttatctaattttttaaaacttacactcttaatatatttatatttttaaacggtcatactcttttttagtattatttggaatatcaaaataaatactatgacaaaaacaatggtaatttt

SEQ ID NO: 308538 - DNA, 3761 bp, Homo sapiens
ttatactttcaggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaagtgttgatcattgttgtcttggtattgcaaactttaacattcagagatgatagagtggttccccactgagaagccaaaacaaggcccttaataaccccttaagttcaccatatgaatcagaaggagaacactaaagtggagagacttttaagagatcatgatagtgaaagccttaatataatcagaattgtaccataaccttgaatctatatttgttcaaaacatccctttgacttttctaagtgtttgcttaagcagagtgtaagaatgtgtggttacctttggttgagatcctttccattctttttgactctctgcttcagattttttcagtagtgtgagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtactgtctaaaacaatacttttttaaaaaaaaggaacagttgggagaaaataaatataatgaaaaattcccagaggctagcacttggattctaacacgtatgctattgtattatccattagttctgtaatatttaattttagattcttttatttttttaattggcaaagcacaaggtgctgtataacagtgtcatttagagttttatagaaagcttcaacctgagttctgcgttataaagcctggagaaagctaagcttagaacataacttgctgaagtataattatctttttgtagcaggaatttatgtgccagaggtgagagtctttctggtactgattttttgagaccaaggataaaaggatcgttttgtaagacatgccatggcaatggctggttgggggacagtttccgcccaagcttggcctattttatttttcctcatacctactttcaaagtcatttaggtatttgaagccttatttcccacgtagtaacactttctggcttttgcagtttctttttttgtttggttttgttttttgcatggaatggggatcaaacaacccgaagaagaacacattttgatcaagcaaaatgtttgcttcaaatttcagaagtttattttacagaaattaaattaagtagtttgacatccttttctctgtttcacacatatattaggttggtgcataagtaattgtggtttttgccatgacttttatggcaaaacctgcaattacttttgcaccaacttaatacatctatatacatatatatatacgcgcacacacttgttcagaagttatgttgtggccttggatttgtttttccccttggaaatggttcttaactctgggattttagaaggttagaatattttttcaagagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagtctctgattagccagagtatagtatgagtcttcactgagaaatatggtgacccattttctttgtgaaaacctgggaaaatgcaagtgtgggtatgaagtgtgtgttctgtttgcattgaaacaatgtaattttgtgtcttctttttgctttaactgacttatttcagaaattgtacagtgttgagggggaaagtcttttctgttaatatatttgcaattcattaaaggatatggaaaatccaaataagttacttttgaaagcaatttataatcaagttgttaaagctatatgaaagctgtgccatctgtattttaataagaaggcacagaaaaacagagatacagttttatgtttcacaaaaaactagagcaatgtttatctaattttttaaaacttacactcttaatatatttatatttttaaacggtcatactcttttttagtattatttggaatatcaaaataaatactatgacaaaaacaatggtaatttt

SEQ ID NO: 308539 - DNA, 3722 bp, Homo sapiens
atgcattttattttcacagcaataagaactaatacaataaggaagtatattgattaagatttagttagcttttgtgaagatgattgggaaatcaaataagtaaaaacgcttggtcaaaactttaaaaatttttgctactttaaggtttttctttgcctttttcagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaagtgttgatcattgttgtcttggtattgcaaactttaaaattgtttcttaccatattgcctcttctctttgagctctgtgggatcacctttaacattcagagatgatagagtggttccccactgagaagccaaaacaaggcccttaataaccccttaagttcaccatatgaatcagaaggagaacactaaagtggagagacttttaagagatcatgatagtgaaagccttaatataatcagaattgtaccataaccttgaatctatatttgttcaaaacatccctttgacttttctaagtgtttgcttaagcagagtgtaagaatgtgtggttacctttggttgagatcctttccattctttttgactctctgcttcagattttttcagtagtgtgagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtactgtctaaaacaatacttttttaaaaaaaaggaacagttgggagaaaataaatataatgaaaaattcccagaggctagcacttggattctaacacgtatgctattgtattatccattagttctgtaatatttaattttagattcttttatttttttaattggcaaagcacaaggtgctgtataacagtgtcatttagagttttatagaaagcttcaacctgagttctgcgttataaagcctggagaaagctaagcttagaacataacttgctgaagtataattatctttttgtagcaggaatttatgtgccagaggtgagagtctttctggtactgattttttgagaccaaggataaaaggatcgttttgtaagacatgccatggcaatggctggttgggggacagtttccgcccaagcttggcctattttatttttcctcatacctactttcaaagtcatttaggtatttgaagccttatttcccacgtagtaacactttctggcttttgcagtttctttttttgtttggttttgttttttgcatggaatggggatcaaacaacccgaagaagaacacattttgatcaagcaaaatgtttgcttcaaatttcagaagtttattttacagaaattaaattaagtagtttgacatccttttctctgtttcacacatatattaggttggtgcataagtaattgtggtttttgccatgacttttatggcaaaacctgcaattacttttgcaccaacttaatacatctatatacatatatatatacgcgcacacacttgttcagaagttatgttgtggccttggatttgtttttccccttggaaatggttcttaactctgggattttagaaggttagaatattttttcaagagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagtctctgattagccagagtatagtatgagtcttcactgagaaatatggtgacccattttctttgtgaaaacctgggaaaatgcaagtgtgggtatgaagtgtgtgttctgtttgcattgaaacaatgtaattttgtgtcttctttttgctttaactgacttatttcagaaattgtacagtgttgagggggaaagtcttttctgttaatatatttgcaattcattaaaggatatggaaaatccaaataagttacttttgaaagcaatttataatcaagttgttaaagctatatgaaagctgtgccatctgtattttaataagaaggcacagaaaaacagagatacagttttatgtttcacaaaaaactagagcaatgtttatctaattttttaaaacttacactcttaatatatttatatttttaaacggtcatactcttttttagtattatttggaatatcaaaataaatactatgacaaaaacaatggtaatttt

SEQ ID NO: 308540 - DNA, 3563 bp, Homo sapiens
ttatactttcaggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaagtgttgatcattgttgtcttggtattgcaaactttaaaattgtttcttaccatattgcctcttctctttgagctctgtgggatcacctttaacattcagagatgatagagtggttccccactgagaagccaaaacaaggcccttaataaccccttaagttcaccatatgaatcagaaggagaacactaaagtggagagacttttaagagatcatgatagtgaaagccttaatataatcagaattgtaccataaccttgaatctatatttgttcaaaacatccctttgacttttctaagtgtttgcttaagcagagtgtaagaatgtgtggttacctttggttgagatcctttccattctttttgactctctgcttcagattttttcagtagtgtgagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtactgtctaaaacaatacttttttaaaaaaaaggaacagttgggagaaaataaatataatgaaaaattcccagaggctagcacttggattctaacacgtatgctattgtattatccattagttctgtaatatttaattttagattcttttatttttttaattggcaaagcacaaggtgctgtataacagtgtcatttagagttttatagaaagcttcaacctgagttctgcgttataaagcctggagaaagctaagcttagaacataacttgctgaagtataattatctttttgtagcaggaatttatgtgccagaggtgagagtctttctggtactgattttttgagaccaaggataaaaggatcgttttgtaagacatgccatggcaatggctggttgggggacagtttccgcccaagcttggcctattttatttttcctcatacctactttcaaagtcatttaggtatttgaagccttatttcccacgtagtaacactttctggcttttgcagtttctttttttgtttggttttgttttttgcatggaatggggatcaaacaacccgaagaagaacacattttgatcaagcaaaatgtttgcttcaaatttcagaagtttattttacagaaattaaattaagtagtttgacatccttttctctgtttcacacatatattaggttggtgcataagtaattgtggtttttgccatgacttttatggcaaaacctgcaattacttttgcaccaacttaatacatctatatacatatatatatacgcgcacacacttgttcagaagttatgttgtggccttggatttgtttttccccttggaaatggttcttaactctgggattttagaaggttagaatattttttcaagagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagtctctgattagccagagtatagtatgagtcttcactgagaaatatggtgacccattttctttgtgaaaacctgggaaaatgcaagtgtgggtatgaagtgtgtgttctgtttgcattgaaacaatgtaattttgtgtcttctttttgctttaactgacttatttcagaaattgtacagtgttgagggggaaagtcttttctgttaatatatttgcaattcattaaaggatatggaaaatcca

SEQ ID NO: 308541 - DNA, 3738 bp, Homo sapiens
ttatactttcaggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaagtgttgatcattgttgtcttggtattgcaaactttaaaattgtttcttaccatattgcctcttctctttgagctctgtgggatcacctttaacattcagagatgatagagtggttccccactgagaagccaaaacaaggcccttaataaccccttaagttcaccatatgaatcagaaggagaacactaaagtggagagacttttaagagatcatgatagtgaaagccttaatataatcagaattgtaccataaccttgaatctatatttgttcaaaacatccctttgacttttctaagtgtttgcttaagcagagtgtaagaatgtgtggttacctttggttgagatcctttccattctttttgactctctgcttcagattttttcagtagtgtgagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtactgtctaaaacaatacttttttaaaaaaaaggaacagttgggagaaaataaatataatgaaaaattcccagaggctagcacttggattctaacacgtatgctattgtattatccattagttctgtaatatttaattttagattcttttatttttttaattggcaaagcacaaggtgctgtataacagtgtcatttagagttttatagaaagcttcaacctgagttctgcgttataaagcctggagaaagctaagcttagaacataacttgctgaagtataattatctttttgtagcaggaatttatgtgccagaggtgagagtctttctggtactgattttttgagaccaaggataaaaggatcgttttgtaagacatgccatggcaatggctggttgggggacagtttccgcccaagcttggcctattttatttttcctcatacctactttcaaagtcatttaggtatttgaagccttatttcccacgtagtaacactttctggcttttgcagtttctttttttgtttggttttgttttttgcatggaatggggatcaaacaacccgaagaagaacacattttgatcaagcaaaatgtttgcttcaaatttcagaagtttattttacagaaattaaattaagtagtttgacatccttttctctgtttcaccaacttaatacatctatatacatatatatatacgcgcacacacttgttcagaagttatgttgtggccttggatttgtttttccccttggaaatggttcttaactctgggattttagaaggttagaatattttttcaagagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagtctctgattagccagagtatagtatgagtcttcactgagaaatatggtgacccattttctttgtgaaaacctgggaaaatgcaagtgtgggtatgaagtgtgtgttctgtttgcattgaaacaatgtaattttgtgtcttctttttgctttaactgacttatttcagaaattgtacagtgttgagggggaaagtcttttctgttaatatatttgcaattcattaaaggatatggaaaatccaaataagttacttttgaaagcaatttataatcaagttgttaaagctatatgaaagctgtgccatctgtattttaataagaaggcacagaaaaacagagatacagttttatgtttcacaaaaaactagagcaatgtttatctaattttttaaaacttacactcttaatatatttatatttttaaacggtcatactcttttttagtattatttggaatatcaaaataaatactatgacaaaaacaatggtaatttt

SEQ ID NO: 308542 - DNA, 3752 bp, Homo sapiens
ttatactttcaggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataagtctgctttacaagaacttgaagaattgaaacaaattgttcccaaagaatccctcgtttacttcttaataggaaagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtgtttgcaagtgccagatggaacaataaaagacgttgcctataacagtgacttgattgccaaggaatgtaaattaccttaaacttgcagtatctcccataaacaaatgtaatgggcatattgggactcgtatgtaggaatcaaatatccctccatacagtgtactcttattcttggcaagaatgctttaatgtctaaccaagaattttaatttattcatcttgcttcaaagtgttgatcattgttgtcttggtattgcaaactttaaaattgtttcttaccatattgcctcttctctttgagctctgtgggatcacctttaacattcagagatgatagagtggttccccactgagaagccaaaacaaggcccttaataaccccttaagttcaccatatgaatcagaaggagaacactaaagtggagagacttttaagagatcatgatagtgaaagccttaatataatcagaattgtaccataaccttgaatctatatttgttcaaaacatccctttgacttttctaagtgtttgcttaagcagagtgtaagaatgtgtggttacctttggttgagatcctttccattctttttgactctctgcttcagattttttcagtagtgtgagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagtcttaaattgtttatctcctttactgtaatgtattgaaatttttagagaaattttagttgttaacattttattaagtgccagtgtcagaatataacaaattatagtttcttatgaatgacaggcctacagttattattctggattatttgatggaggacaaacttacctgtatttgttagtcaagctgtgaaaataaggtggattacaaaagatgtgaaaaaaattttagtctgtagactcagtaattttctataatttactgttaatctcatttgaacatggattaggtacaatttataaattaattcaagtcagggtctttaggtatcaggtgccagagagatatttaacagatttccctacctaaatttatgtatatgtactgtctaaaacaatacttttttaaaaaaaaggaacagttgggagaaaataaatataatgaaaaattcccagaggctagcacttggattctaacacgtatgctattgtattatccattagttctgtaatatttaattttagattcttttatttttttaattggcaaagcacaaggtgctgtataacagtgtcatttagagttttatagaaagcttcaacctgagttctgcgttataaagcctggagaaagctaagcttagaacataacttgctgaagtataattatctttttgtagcaggaatttatgtgccagaggtgagagtctttctggtactgattttttgagaccaaggataaaaggatcgttttgtaagacatgccatggcaatggctggttgggggacagtttccgcccaagcttggcctattttatttttcctcatacctactttcaaagtcatttaggtatttgaagccttatttcccacgtagtaacactttctggcttttgcagtttctttttttgtttggttttgttttttgcatggaatggggatcaaacaacccgaagaagaacacattttgatcaagcaaaatgtttgcttcaaatttcagaagtttattttacagaaattaaattaagtagtttgacatccttttctctgtttcacacatatattaggttggtgcataagtaattgtggtttttgccatgacttttatggcaaaacctgcaattacttttgcaccaacttaatacatctatatacatatatatatacgcgcacacacttgttcagaagttatgttgtggccttggatttgtttttccccttggaaatggttcttaactctgggattttagaaggttagaatattttttcaagagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagtctctgattagccagagtatagtatgagtcttcactgagaaatatggtgacccattttctttgtgaaaacctgggaaaatgcaagtgtgggtatgaagtgtgtgttctgtttgcattgaaacaatgtaattttgtgtcttctttttgctttaactgacttatttcagaaattgtacagtgttgagggggaaagtcttttctgttaatatatttgcaattcattaaaggatatggaaaatccaaataagttacttttgaaagcaatttataatcaagttgttaaagctatatgaaagctgtgccatctgtattttaataagaaggcacagaaaaacagagatacagttttatgtttcacaaaaaactagagcaatgtttatctaattttttaaaacttacactcttaatatatttatatttttaaacggtcatactcttttttagtattatttggaatatcaaaataaatactatgacaaaaacaatggtaatttt

SEQ ID NO: 308543 - DNA, 726 bp, Homo sapiens
gcggatctctgaggatccccatagttttagaagtttcaatagaacagtggtactcaaaagaatgaaaggtggtccctacattttctgtattcatcacttaaaatttttaatttttccgagaactacaagtaacatttgaaccatgctgctgttgtaccttaaacaaaaactcagtgataaccagtatttagtctattaaaaatgctctttttgaagaaaaaagtttggaagtctctgattagccagagtatagtatgagtcttcactgagaaatatggtgacccattttctttgtgaaaacctgggaaaatgcaagtgtgggtatgaagtgtgtgttctgtttgcattgaaacaatgtaattttgtgtcttctttttgctttaactgacttatttcagaaattgtacagtgttgagggggaaagtcttttctgttaatatatttgcaattcattaaaggatatggaaaatccaaataagttacttttgaaagcaatttataatcaagttgttaaagctatatgaaagctgtgccatctgtattttaataagaaggcacagaaaaacagagatacagttttatgtttcacaaaaaactagagcaatgtttatctaattttttaaaacttacactcttaatatatttatatttttaaacggtcatactcttttttagtattatttggaatatcaaaataaatactatgacaaaaacaatggtaatttt

SEQ ID NO: 308544 - DNA, 972 bp, Homo sapiens
atgcattttattttcacagcaataagaactaatacaataaggaagtatattgattaagatttagttagcttttgtgaagatgattgggaaatcaaataagtaaaaacgcttggtcaaaactttaaaaatttttgctactttaaggtttttctttgcctttttcagtctgctttacaagaacttgaagaattgaaacaaattgttcccaaagaatccctcgtttacttcttaataggaaaggtttacaagaagttaggtcaaacgcacctcgccctgatgaatttctcttgggctatggatttagatcctaaaggagccaataaccagattaaagaggcaattgataagcgttatcttccagatgatgaggagccaataacccaagaagaacagatcatgggaacagatgaatcccaggagagcagcatgacagatgcggatgacacacaacttcatgcagctgaaagtgatgaattttaacttctggaaatcagacttttacaactggatgtgtgactagtgctgacgtgtttcttgtccctctgtatactgagtctttactcttgagctggcggtgtcatcgtccgtcacttataccatgagtgtgccactttcattggaccctgactgtatacagaatgaaaggcagtgcaatatttagctgctaacaagactggctcttttaccagtatgaatgacaatttatggggggtagggtggggaactttcttttctgtttttctttaatctccctttgttggaaagtatcatgaaaggaagagttatgctttatcttgaaggaaccattagatatggaaaatagtgatgaaccagagtttcttggttgctttttcaaaaatttgtttttatttggttctgttcctgataaacagagtaactgaccttcatttctaggttcttcaagaatggtcagttactctgtttatcaggaacagaaccaaaaaaaaaaaa

SEQ ID NO: 308545 - DNA, 348 bp, Homo sapiens
ttatactttcaggtatggtttaggaatgatttattacaagcaagaaaaattcagccttgcagaaatgcatttccaaaaagcgcttgatatcaaccctcaaagttcagttttactttgccacattggagtagttcaacatgcactgaaaaaatcagagaaggctttggataccctaaacaaagccattgtcattgatcccaagaaccctctatgcaaatttcacagagcctcagttttatttgcaaatgaaaaatataaggtaagataaatatcttaagggtcttcagtgttgtattgcttaaaaacaacgttatcccttgttttcaataaactgaaagttatttattt

SEQ ID NO: 308546 - DNA, 658 bp, Homo sapiens
ctgccatttcttagtacctattgtcatataagtatgcattttattttcacagcaataagaactaatacaataaggaagtatattgattaagatttagttagcttttgtgaagatgattgggaaatcaaataagtaaaaacgcttggtcaaaactttaaaaatttttgctactttaaggtttttctttgcctttttcagtctgctttacaagaacttgaagaattgaaacaaattgttcccaaagaatccctcgtttacttcttaataggaaaggtaaagactggggtcatggtcccaaacagtgactttcatagcaaataatgacattttataagaataaatgtaatacttcctgtacatatctattgagcaaattaaactaaagctccgaactgagtgctctgggaataacagatttagttctaacacttaagaaaatgatatcctagccaggcatggtgcctcacgcctgtaatcccagcactttgggaggcctaggcaggtagattacgtgaggtcaggagtttaagaccagcctgaccaacatggtgaaacctgacctctactaaaaatacaaaaaattagctgggcatggtgacacatgcctgtaatcccagctactccagaggctgaggcacgagaatcacttgaacctggg

SEQ ID NO: 308547 - DNA, 463 bp, Homo sapiens
tatgtaccagaggacctagatttttatcacagagcaaattatttaagatctctagacttcagtattctcatctttagtgaagcagttgaactagaattagaagtgattttagagataatctattaatcatttggtaattaattactaaatccacttaatgcagtggacaatccagttagaccctacaaccttatctctaataatttgattatgttggttttgagtcacgttggttctcacctttcttcataaatatcaagagggagtattaacatgatctttatttcttacaggttcaacatgcactgaaaaaatcagagaaggctttggataccctaaacaaagccattgtcattgatcccaagaaccctctatgcaaatttcacagagcctcagttttatttgcaaatgaaaaatataaggtaagataaatatcttaagggtcttcagtgttgtattgctt

SEQ ID NO: 308548 - DNA, 3345 bp, Homo sapiens
gcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccagggaggcagtgggggccttgttgggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttcca

SEQ ID NO: 308549 - DNA, 3292 bp, Homo sapiens
gcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccagggaggcagtgggggccttgttgggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttcca

SEQ ID NO: 308550 - DNA, 3375 bp, Homo sapiens
gcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttcca

SEQ ID NO: 308551 - DNA, 3663 bp, Homo sapiens
  misc_feature (3395)..(3395): n is a, c, g, or t
gcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggcccaaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccaaaaaaaaaaaaaaaaaaaanaaaaaaaaaaaaaaaaaaaaaaacacacacaagacacaaaacaatcaccgagaggcgcaaaagtgcgggacggggacaacaaagggaaggagaggagagacagaaacggacgcgacaaagagacggagcagagcacacgacagtacgtgatcgcgataagaggggagaggagagatgggccggaacccgcaatgttgagggggaagctgctttataagttggcacagaaagagggaggaaaagagaaggatacacacagaggagaaaa

SEQ ID NO: 308552 - DNA, 4870 bp, Homo sapiens
gcaggacccggaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttaggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtccttatgaaacaagaaaaagaaaatgaaaagtattattaagcttctgtgtttgtctaaaaatgtggcatatggatggcatttaaaactttgaatgaattatacctaaatctgggacagggaggtgacagtggaacaggctaccaatcagaactagatgacttttaaggctcctcctattatgagacttcaatttccaaagagaagaactagcagagaaattgtatttcagtaattttaagctccttctgtcttgtagagtcttgttatagttgtataaatcaaaaacacagaataaggaacatatttaactttttttcattataaaatggttagaggaccctaccccctctagattccctgatttccccaggcctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattcttttaaaataaaattaatatttataatggatatttaatgattgttatttttaaaaaccagcttataattcctcgttatgcatgatttatccaaagtttccatagttttattcaaaataataaatgttaataaggtgataaggggtatatttaatgtattgtatcaaattgtgaataagaaagtaggatggagctttctagaggttgggccttagttctgttatcctcattgcttttaaccaataagttaaatgaagttagagttatggtcttcaggttagattatggaccagatctgtgagggtcagcatggaaattcacattcaacaaggtagcacacaggaccaagagcagcacatgcaatcaactggaataatatagtaatcctgtaactgggtttgaaaaaataatcaacaaaagatacaattcaagggttaggttgcagagagctggcttgagagtagttattatgaaaaaggcctcaaggagtacgtgttcagtatgctctaagatgataaagtggctgttaaaaagggagttgatttgaggaagtattacttagcattcatgcatattgggcttaggctctagccctgccactatcattgtcttctctggactgtgaagtcactgaggacaaggaaactaaatttaatgtctgtatcactagtgcctagaatttctggacacttagtagtcaccatcaggcgtttatttaatgaatgagaagcaaagtgaccttggttacttttttaccctgaggggctcagcactcattaggacttggtgcctaattttataaaaagtcactaagctcaagtgcttggatgaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaacaatgactgtaacgtgttatagatgtaaagacaaaataaaggttaaagagggcataaaggagcactcaattgcagagatttgaggacattatttttattttgagctttaaaaagatgaataggtgttctcaggaggtagggatctggctgagagggaataatctgagcaaaggtatgaaacagcctaatgcattagagaaaaaagttcttttagtaaggcatttggggttggggaagctagaaaaagaaatgggagctggtcacacagggccttgtgtgccagactaaggggtttgtagtatatattgtaggcagaagagatccatcaacagattgcaagcaaggaagtatgttcactttaaagtttgagaaagaatagtgtggaagcacgtctcaaatttagacttacttgttccccctctgaaccgtgaatcagaccatttcaggtagaagtcttccccggtttatctgatctactcggggcctcaggcttctcagctgggaagagaggatgcaagaccagactgaagaacacggttgagtccccagaaccaaaagggggcctttctgcttcttagccagctacctcttcgagtttttcaaattgtgagggggaccataaaaggatggaaacttttagatgacattctacaaattatttttttctttaaattaaaagaacctagccaataagatagagaatgggcatctaaggcatctcagagctctctgatgaagccaggttgtcaaagatcatttgcaaaagaagggaaaactggcatgacaaaagctacagagaggagagtgaaatatagaagtgtttgaaatgttcaagctcacaataagcttaaatttatagaaaatgctaaggttgtcaagaaggcttttttttttttcttttttaaacctgagggcaaaaaggaatggataaagtagtgtaatggattgacaatcaggaagaacagaataactcagtttttttttctcctacaaggagatatggctggaccaaaataaaatgacatgaaattgcaaaaatgaaaat

SEQ ID NO: 308553 - DNA, 606 bp, Homo sapiens
  misc_feature (551)..(551): n is a, c, g, or t
  misc_feature (563)..(563): n is a, c, g, or t
  misc_feature (597)..(597): n is a, c, g, or t
  misc_feature (600)..(600): n is a, c, g, or t
gcaggacccggaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcacttctggacataagcccaggagatacagggattaaggccaaaataccccaacccttnaaaaatggtttncgtaaatgggggaatggaatggattgaaagaagnagnaattcc

SEQ ID NO: 308554 - DNA, 1230 bp, Homo sapiens
  misc_feature (974)..(974): n is a, c, g, or t
  misc_feature (976)..(976): n is a, c, g, or t
  misc_feature (979)..(979): n is a, c, g, or t
  misc_feature (981)..(982): n is a, c, g, or t
  misc_feature (993)..(993): n is a, c, g, or t
  misc_feature (1000)..(1001): n is a, c, g, or t
  misc_feature (1008)..(1008): n is a, c, g, or t
  misc_feature (1229)..(1229): n is a, c, g, or t
gcaggacccggaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggnantgncnnagaaggctgcnttccatnntctttcntgaagaaatcggacgtggcaatattcagaatgaagtaggtggattatagggacaggggatactttaatgcgttggcacttaatcctttggttagaatcgggagggtgacgcatgcagtagtagtgttgggatagagtatcgtgtgaggcgcttgagcgagtagcgactgcgcaaggtggctaggaactgtagggagaattcagatttatgtggttgtatanc

SEQ ID NO: 308555 - DNA, 919 bp, Homo sapiens
gcaggacccggaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggtactacgctttggcattgggtactacgctttggca

SEQ ID NO: 308556 - DNA, 4913 bp, Homo sapiens
gcaggacccggaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttggggagctatgaacaaaaattttttgtggaattggtttggaacttttaacaaaattgtgggaatttccaagggattaaaaatgttgtttcctttcgttgttcccgagaaaataacatttggaaaaatgggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttaggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtccttatgaaacaagaaaaagaaaatgaaaagtattattaagcttctgtgtttgtctaaaaatgtggcatatggatggcatttaaaactttgaatgaattatacctaaatctgggacagggaggtgacagtggaacaggctaccaatcagaactagatgacttttaaggctcctcctattatgagacttcaatttccaaagagaagaactagcagagaaattgtatttcagtaattttaagctccttctgtcttgtagagtcttgttatagttgtataaatcaaaaacacagaataaggaacatatttaactttttttcattataaaatggttagaggaccctaccccctctagattccctgatttccccaggcctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattcttttaaaataaaattaatatttataatggatatttaatgattgttatttttaaaaaccagcttataattcctcgttatgcatgatttatccaaagtttccatagttttattcaaaataataaatgttaataaggtgataaggggtatatttaatgtattgtatcaaattgtgaataagaaagtaggatggagctttctagaggttgggccttagttctgttatcctcattgcttttaaccaataagttaaatgaagttagagttatggtcttcaggttagattatggaccagatctgtgagggtcagcatggaaattcacattcaacaaggtagcacacaggaccaagagcagcacatgcaatcaactggaataatatagtaatcctgtaactgggtttgaaaaaataatcaacaaaagatacaattcaagggttaggttgcagagagctggcttgagagtagttattatgaaaaaggcctcaaggagtacgtgttcagtatgctctaagatgataaagtggctgttaaaaagggagttgatttgaggaagtattacttagcattcatgcatattgggcttaggctctagccctgccactatcattgtcttctctggactgtgaagtcactgaggacaaggaaactaaatttaatgtctgtatcactagtgcctagaatttctggacacttagtagtcaccatcaggcgtttatttaatgaatgagaagcaaagtgaccttggttacttttttaccctgaggggctcagcactcattaggacttggtgcctaattttataaaaagtcactaagctcaagtgcttggatgaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaacaatgactgtaacgtgttatagatgtaaagacaaaataaaggttaaagagggcataaaggagcactcaattgcagagatttgaggacattatttttattttgagctttaaaaagatgaataggtgttctcaggaggtagggatctggctgagagggaataatctgagcaaaggtatgaaacagcctaatgcattagagaaaaaagttcttttagtaaggcatttggggttggggaagctagaaaaagaaatgggagctggtcacacagggccttgtgtgccagactaaggggtttgtagtatatattgtaggcagaagagatccatcaacagattgcaagcaaggaagtatgttcactttaaagtttgagaaagaatagtgtggaagcacgtctcaaatttagacttacttgttccccctctgaaccgtgaatcagaccatttcaggtagaagtcttccccggtttatctgatctactcggggcctcaggcttctcagctgggaagagaggatgcaagaccagactgaagaacacggttgagtccccagaaccaaaagggggcctttctgcttcttagccagctacctcttcgagtttttcaaattgtgagggggaccataaaaggatggaaacttttagatgacattctacaaattatttttttctttaaattaaaagaacctagccaataagatagagaatgggcatctaaggcatctcagagctctctgatgaagccaggttgtcaaagatcatttgcaaaagaagggaaaactggcatgacaaaagctacagagaggagagtgaaatatagaagtgtttgaaatgttcaagctcacaataagcttaaatttatagaaaatgctaaggttgtcaagaaggcttttttttttttcttttttaaacctgagggcaaaaaggaatggataaagtagtgtaatggattgacaatcaggaagaacagaataactcagtttttttttctcctacaaggagatatggctggaccaaaataaaatgacatgaaattgcaaaaatgaaaat

SEQ ID NO: 308557 - DNA, 4965 bp, Homo sapiens
  misc_feature (7)..(7): n is a, c, g, or t
  misc_feature (16)..(16): n is a, c, g, or t
cagattncacggccgntgcgactacggctgcgcagaagacgacagaaggaatcagagaaaaatctttaactccaccattagcacccaaagctaagattctaatttaaactattctctgttctttcatggggaagcagatttgggtaccacccaagtattgactcacccatcaacaaccaaaaaaaaaaaaaaaaaaaaaaaaagcgccgctcgtcgacgcggccgcgaattcgcggcgtgcaaagcgggctgcgagaagacgacagaagggagcgcctgtccctgtcacggaccccagcgttaccatgcatcctgccgtcttcctatccttacccgacctcagatgctcccttctgctcctggtaacttgggtttttactcctgtaacaactgaaataacaagtcttgatacagagaatatagatgaaattttaaacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttaggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtccttatgaaacaagaaaaagaaaatgaaaagtattattaagcttctgtgtttgtctaaaaatgtggcatatggatggcatttaaaactttgaatgaattatacctaaatctgggacagggaggtgacagtggaacaggctaccaatcagaactagatgacttttaaggctcctcctattatgagacttcaatttccaaagagaagaactagcagagaaattgtatttcagtaattttaagctccttctgtcttgtagagtcttgttatagttgtataaatcaaaaacacagaataaggaacatatttaactttttttcattataaaatggttagaggaccctaccccctctagattccctgatttccccaggcctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattcttttaaaataaaattaatatttataatggatatttaatgattgttatttttaaaaaccagcttataattcctcgttatgcatgatttatccaaagtttccatagttttattcaaaataataaatgttaataaggtgataaggggtatatttaatgtattgtatcaaattgtgaataagaaagtaggatggagctttctagaggttgggccttagttctgttatcctcattgcttttaaccaataagttaaatgaagttagagttatggtcttcaggttagattatggaccagatctgtgagggtcagcatggaaattcacattcaacaaggtagcacacaggaccaagagcagcacatgcaatcaactggaataatatagtaatcctgtaactgggtttgaaaaaataatcaacaaaagatacaattcaagggttaggttgcagagagctggcttgagagtagttattatgaaaaaggcctcaaggagtacgtgttcagtatgctctaagatgataaagtggctgttaaaaagggagttgatttgaggaagtattacttagcattcatgcatattgggcttaggctctagccctgccactatcattgtcttctctggactgtgaagtcactgaggacaaggaaactaaatttaatgtctgtatcactagtgcctagaatttctggacacttagtagtcaccatcaggcgtttatttaatgaatgagaagcaaagtgaccttggttacttttttaccctgaggggctcagcactcattaggacttggtgcctaattttataaaaagtcactaagctcaagtgcttggatgaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaacaatgactgtaacgtgttatagatgtaaagacaaaataaaggttaaagagggcataaaggagcactcaattgcagagatttgaggacattatttttattttgagctttaaaaagatgaataggtgttctcaggaggtagggatctggctgagagggaataatctgagcaaaggtatgaaacagcctaatgcattagagaaaaaagttcttttagtaaggcatttggggttggggaagctagaaaaagaaatgggagctggtcacacagggccttgtgtgccagactaaggggtttgtagtatatattgtaggcagaagagatccatcaacagattgcaagcaaggaagtatgttcactttaaagtttgagaaagaatagtgtggaagcacgtctcaaatttagacttacttgttccccctctgaaccgtgaatcagaccatttcaggtagaagtcttccccggtttatctgatctactcggggcctcaggcttctcagctgggaagagaggatgcaagaccagactgaagaacacggttgagtccccagaaccaaaagggggcctttctgcttcttagccagctacctcttcgagtttttcaaattgtgagggggaccataaaaggatggaaacttttagatgacattctacaaattatttttttctttaaattaaaagaacctagccaataagatagagaatgggcatctaaggcatctcagagctctctgatgaagccaggttgtcaaagatcatttgcaaaagaagggaaaactggcatgacaaaagctacagagaggagagtgaaatatagaagtgtttgaaatgttcaagctcacaataagcttaaatttatagaaaatgctaaggttgtcaagaaggcttttttttttttcttttttaaacctgagggcaaaaaggaatggataaagtagtgtaatggattgacaatcaggaagaacagaataactcagtttttttttctcctacaaggagatatggctggaccaaaataaaatgacatgaaattgcaaaaatgaaaat

SEQ ID NO: 308558 - DNA, 4797 bp, Homo sapiens
gcaggacccggaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctgacaatgctgatgttgctttagtaaatttttatgctgactggtgtcgtttcagtcagatgttgcatccaatttttgaggaagcttccgatgtcattaaggaagaatttccaaatgaaaatcaagtagtgtttgccagagttgattgtgatcagcactctgacatagcccagagatacaggataagcaaatacccaaccctcaaattgtttcgtaatgggatgatgatgaagagagaatacaggggtcagcgatcagtgaaagcattggcagattacatcaggcaacaaaaaagtgaccccattcaagaaattcgggacttagcagaaatcaccactcttgatcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttaggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtccttatgaaacaagaaaaagaaaatgaaaagtattattaagcttctgtgtttgtctaaaaatgtggcatatggatggcatttaaaactttgaatgaattatacctaaatctgggacagggaggtgacagtggaacaggctaccaatcagaactagatgacttttaaggctcctcctattatgagacttcaatttccaaagagaagaactagcagagaaattgtatttcagtaattttaagctccttctgtcttgtagagtcttgttatagttgtataaatcaaaaacacagaataaggaacatatttaactttttttcattataaaatggttagaggaccctaccccctctagattccctgatttccccaggcctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattcttttaaaataaaattaatatttataatggatatttaatgattgttatttttaaaaaccagcttataattcctcgttatgcatgatttatccaaagtttccatagttttattcaaaataataaatgttaataaggtgataaggggtatatttaatgtattgtatcaaattgtgaataagaaagtaggatggagctttctagaggttgggccttagttctgttatcctcattgcttttaaccaataagttaaatgaagttagagttatggtcttcaggttagattatggaccagatctgtgagggtcagcatggaaattcacattcaacaaggtagcacacaggaccaagagcagcacatgcaatcaactggaataatatagtaatcctgtaactgggtttgaaaaaataatcaacaaaagatacaattcaagggttaggttgcagagagctggcttgagagtagttattatgaaaaaggcctcaaggagtacgtgttcagtatgctctaagatgataaagtggctgttaaaaagggagttgatttgaggaagtattacttagcattcatgcatattgggcttaggctctagccctgccactatcattgtcttctctggactgtgaagtcactgaggacaaggaaactaaatttaatgtctgtatcactagtgcctagaatttctggacacttagtagtcaccatcaggcgtttatttaatgaatgagaagcaaagtgaccttggttacttttttaccctgaggggctcagcactcattaggacttggtgcctaattttataaaaagtcactaagctcaagtgcttggatgaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaacaatgactgtaacgtgttatagatgtaaagacaaaataaaggttaaagagggcataaaggagcactcaattgcagagatttgaggacattatttttattttgagctttaaaaagatgaataggtgttctcaggaggtagggatctggctgagagggaataatctgagcaaaggtatgaaacagcctaatgcattagagaaaaaagttcttttagtaaggcatttggggttggggaagctagaaaaagaaatgggagctggtcacacagggccttgtgtgccagactaaggggtttgtagtatatattgtaggcagaagagatccatcaacagattgcaagcaaggaagtatgttcactttaaagtttgagaaagaatagtgtggaagcacgtctcaaatttagacttacttgttccccctctgaaccgtgaatcagaccatttcaggtagaagtcttccccggtttatctgatctactcggggcctcaggcttctcagctgggaagagaggatgcaagaccagactgaagaacacggttgagtccccagaaccaaaagggggcctttctgcttcttagccagctacctcttcgagtttttcaaattgtgagggggaccataaaaggatggaaacttttagatgacattctacaaattatttttttctttaaattaaaagaacctagccaataagatagagaatgggcatctaaggcatctcagagctctctgatgaagccaggttgtcaaagatcatttgcaaaagaagggaaaactggcatgacaaaagctacagagaggagagtgaaatatagaagtgtttgaaatgttcaagctcacaataagcttaaatttatagaaaatgctaaggttgtcaagaaggcttttttttttttcttttttaaacctgagggcaaaaaggaatggataaagtagtgtaatggattgacaatcaggaagaacagaataactcagtttttttttctcctacaaggagatatggctggaccaaaataaaatgacatgaaattgcaaaaatgaaaat

SEQ ID NO: 308559 - DNA, 4456 bp, Homo sapiens
gcaggacccggaagtgagggtgtgagaggcctctctggaagttgtcccgggtgttcgccgctggagcccgggtcgagaggacgaggtgccgctgcctggagaatcctccgctgccgtcggctcccggagcccagccctttcctaacccaacccaacctagcccagtcccagccgccagcgcctgtccctgtcacggaccccagcgttaccatgcatcctgccgtcttcctatccttacccgacctcagatgctcccttctgctcctgcgcagcaaaagaaatatcattggatattttgagcaaaaggactcggacaactatagagtttttgaacgagtagcgaatattttgcatgatgactgtgcctttctttctgcatttggggatgtttcaaaaccggaaagatatagtggcgacaacataatctacaaaccaccagggcattctgctccggatatggtgtacttgggagctatgacaaattttgatgtgacttacaattggattcaagataaatgtgttcctcttgtccgagaaataacatttgaaaatggagaggaattgacagaagaaggactgccttttctcatactctttcacatgaaagaagatacagaaagtttagaaatattccagaatgaagtagctcggcaattaataagtgaaaaaggtacaataaactttttacatgccgattgtgacaaatttagacatcctcttctgcacatacagaaaactccagcagattgtcctgtaatcgctattgacagctttaggcatatgtatgtgtttggagacttcaaagatgtattaattcctggaaaactcaagcaattcgtatttgacttacattctggaaaactgcacagagaattccatcatggacctgacccaactgatacagccccaggagagcaagcccaagatgtagcaagcagtccacctgagagctccttccagaaactagcacccagtgaatataggtatactctattgagggatcgagatgagctttaaaaacttgaaaaacagtttgtaagcctttcaacagcagcatcaacctacgtggtggaaatagtaaacctatattttcataattctatgtgtatttttattttgaataaacagaaagaaattttgggtttttaatttttttctccccgactcaaaatgcattgtcatttaatatagtagcctcttaaaaaaaaaaaaacctgctaggatttaaaaataaaaatcagaggcctatctccactttaaatctgtcctgtaaaagttttataaatcaaatgaaaggtgacattgccagaaacttaccattaacttgcactactagggtagggaggacttaggatgtttcctgtgtcgtatgtgcttttctttctttcatatgatcaattctgttggtattttcagtatctcatttctcaaagctaaagagatatacattctggatacttgggaggggaataaattaaagttttcacactgtgtactgtgttttactgattggttggatattgcttatgaaaattccatagtggtatttttttggattcttaatgtgtaacttaaacatactttgaagtggaggagagtcataagacagaacatttggcaggaattgtccttatgaaacaagaaaaagaaaatgaaaagtattattaagcttctgtgtttgtctaaaaatgtggcatatggatggcatttaaaactttgaatgaattatacctaaatctgggacagggaggtgacagtggaacaggctaccaatcagaactagatgacttttaaggctcctcctattatgagacttcaatttccaaagagaagaactagcagagaaattgtatttcagtaattttaagctccttctgtcttgtagagtcttgttatagttgtataaatcaaaaacacagaataaggaacatatttaactttttttcattataaaatggttagaggaccctaccccctctagattccctgatttccccaggcctgcagcatacagtaagatgggtccctgtgccaggcctcaatactgccagggaataaaaccagagggagaggaccctcagtgtcatatcaggaagcccagtgccagaggacagacaggttcaaaactggcttttcctctgggcctgggttggtgctataggccaagggtcattttatacttgggtataaatcaatcccagtttgggaaaagattatttttaagcttaaaaggctgacatgtgccattatatgtagtatgtaatatatgtaacatcttccaattcttttaaaataaaattaatatttataatggatatttaatgattgttatttttaaaaaccagcttataattcctcgttatgcatgatttatccaaagtttccatagttttattcaaaataataaatgttaataaggtgataaggggtatatttaatgtattgtatcaaattgtgaataagaaagtaggatggagctttctagaggttgggccttagttctgttatcctcattgcttttaaccaataagttaaatgaagttagagttatggtcttcaggttagattatggaccagatctgtgagggtcagcatggaaattcacattcaacaaggtagcacacaggaccaagagcagcacatgcaatcaactggaataatatagtaatcctgtaactgggtttgaaaaaataatcaacaaaagatacaattcaagggttaggttgcagagagctggcttgagagtagttattatgaaaaaggcctcaaggagtacgtgttcagtatgctctaagatgataaagtggctgttaaaaagggagttgatttgaggaagtattacttagcattcatgcatattgggcttaggctctagccctgccactatcattgtcttctctggactgtgaagtcactgaggacaaggaaactaaatttaatgtctgtatcactagtgcctagaatttctggacacttagtagtcaccatcaggcgtttatttaatgaatgagaagcaaagtgaccttggttacttttttaccctgaggggctcagcactcattaggacttggtgcctaattttataaaaagtcactaagctcaagtgcttggatgaaaggacagcgtggataaaaaggtttttaaaacatggatgttaaggctgttttgcttggagaagacttgggactgggacagtctttagatattatttgaaatgctggcactgtctatctggatcccagggcttgaactaggatttgaggaagtcacagggaagcagatttcagtctgacatttattcagtgcaagttttttggtgctgtagtatatgatgaaagatgtaaagctgaataaagcattatttctgccctagagttgttcacagcctagtcaggcatatggatatgtaaacaatgactgtaacgtgttatagatgtaaagacaaaataaaggttaaagagggcataaaggagcactcaattgcagagatttgaggacattatttttattttgagctttaaaaagatgaataggtgttctcaggaggtagggatctggctgagagggaataatctgagcaaaggtatgaaacagcctaatgcattagagaaaaaagttcttttagtaaggcatttggggttggggaagctagaaaaagaaatgggagctggtcacacagggccttgtgtgccagactaaggggtttgtagtatatattgtaggcagaagagatccatcaacagattgcaagcaaggaagtatgttcactttaaagtttgagaaagaatagtgtggaagcacgtctcaaatttagacttacttgttccccctctgaaccgtgaatcagaccatttcaggtagaagtcttccccggtttatctgatctactcggggcctcaggcttctcagctgggaagagaggatgcaagaccagactgaagaacacggttgagtccccagaaccaaaagggggcctttctgcttcttagccagctacctcttcgagtttttcaaattgtgagggggaccataaaaggatggaaacttttagatgacattctacaaattatttttttctttaaattaaaagaacctagccaataagatagagaatgggcatctaaggcatctcagagctctctgatgaagccaggttgtcaaagatcatttgcaaaagaagggaaaactggcatgacaaaagctacagagaggagagtgaaatatagaagtgtttgaaatgttcaagctcacaataagcttaaatttatagaaaatgctaaggttgtcaagaaggcttttttttttttcttttttaaacctgagggcaaaaaggaatggataaagtagtgtaatggattgacaatcaggaagaacagaataactcagtttttttttctcctacaaggagatatggctggaccaaaataaaatgacatgaaattgcaaaaatgaaaat

SEQ ID NO: 308560 - DNA, 778 bp, Homo sapiens
gctgcagtgagccgagattgtgccactgcactctagcctgggtgacagagtaagaccccatctcaatttaaaatatatatattatttcaaactttaaaaagattctaaaaatagtacaaataattcccatatacccttcacttagcttcctcaaacattaacaccttatgtaaccgtagtccaaataccaagataagaaaattaacattagcagtctctagacctcattcccattttaatcagttgtctcactgatgtcctatttctgccccgggaccctctctggagccacacagttagttgttagacctccctgtctccttcgatgtgggatagttccagtctttttttgtcatgaccttggtatttttgaagagtactggccattgactttggaaagcccttcagcttggattgtctggtgttttctcattatttggagttttacatttttggtaagaataaagtgctgttttgcccttccaggacctctttcaaggtggcacatgtggtcggtatatcttatcttaggtggtgctaattttgattattagttaaggtggtgtctgccacgtttctccactgtaaaatcactatccttccctttacaattggtcagtatatttgggggagataattttaaactatgtagatgtcctagttctagctaccattgatgagattactgtggtatttgagaaattgtgatttttaaaaactttttacgtgtattaattggaattctataaggagccaatttctgttctccatttattca

SEQ ID NO: 308561 - DNA, 2376 bp, Homo sapiens
tccagcgcgtgcccggggcggcggcgcgcggcggggggtggttggggtgcgcgccggcccgagtggacgccgtcgcgaccgccatgcagctgacggtgaaggcgctgcagggccgcgagtgcagcctgcaggtgccagaggacgagctggtgtccacgctgaagcagctggtctccgagaagctgaacgtcccagtgcgccagcagcggctgctgttcaagggcaaggccctggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcgtcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccgagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagcgtgacccagagatggggtgtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtgggggcagaagcatgggctgggttccggttcatcctcctccaccctgccgtgtgtgtgggcacaagaggacatctaaccacctgctccttggaggaggcccccaggggtggtagaggctggaaggaagccacatcaggaggacgccactccggcccttcacccttgccaagtgagctgctcacagtgtggtcagggctgcgcgtgctggaggccctcctgcctgggccttgtggggcaaatattgggtccccaggctggaaagatggacagaggcccaatgggtgaaggctttgaagagcacacagaagcccctggccccccacgagagctggagagccatgtatatggcttcaaagccacctacggcagggacacactcgtgagcatgtgtggcctgcagttcaggtgatacatttaccagtgttcttgtttgtgtggtgccaggaaattgattttggaaaaagtgaaataacattaaaggtgaatgtgaggcttctacttttatccaaaaggagctatattagctaggctgtttctgatatccaatcattggtttaacaataaaggcaatttgtttaatcagttaacggaaatttcttggcttatgaaagtgaaaagtccagtggtattggcattggcagcaggtgagcaatttcacccagtgtcttctgcctccctctgcgttggtatctgctacatcccaggccaccacctccgaggatgaaaagatggctgcctgcagcttccacggaatccctccctcactgccagagcagcatcttctctgtgtaccacctctgctgtctcagatgcccccagcaaataaacactcttctcgttggtca

SEQ ID NO: 308562 - DNA, 2113 bp, Homo sapiens
tccagcgcgtgcccggggcggcggcgcgcggcggggggtggttggggtgcgcgccggcccgagtggacgccgtcgcgaccgccatgcagctgacggtgaaggcgctgcagggccgcgagtgcagcctgcaggtgccagaggacgagctggtgtccacgctgaagcagctggtctccgagaagctgaacgtcccagtgcgccagcagcggctgctgttcaagggcaaggccctggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcgtcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccgagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagcgtgacccagagatggggtgtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtgggggcagaagcatgggctgggttccggttcatcctcctccaccctgccgtgtgtgtgggcacaagaggacatctaaccacctgctccttggaggaggcccccaggggtggtagaggctggaaggaagccacatcaggaggacgccactccggcccttcacccttgccaagtgagctgctcacagtgtggtcagggctgcgcgtgctggaggccctcctgcctgggccttgtggggcaaatattgggtccccaggctggaaagatggacagaggcccaatgggtgaaggctttgaagagcacacagaagcccctggccccccacgagagctggagagccatgtatatggcttcaaagccacctacggcagggacacactcgtgagcatgtgtggcctgcagttcaggtgatacatttaccagtgttcttgtttgtgtggtgccaggaaattgattttggaaaaagtgaaataacattaaaggtgaatgtgaggcttctacttttatccaaaaggagctatattagctaggctgtttctgatatccaatcattggtttaacaataaaggcaatttgtttaatca

SEQ ID NO: 308563 - DNA, 2262 bp, Homo sapiens
gcggccgcatgcctcacagccggatgccgcagcgctccgctcccgccgcccgaggcggcctcgcgccccgggccacccccacggcggtggaggaggaggaacccatcgatctgtctttggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcgtcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccgagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagcgtgacccagagatggggtgtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtgggggcagaagcatgggctgggttccggttcatcctcctccaccctgccgtgtgtgtgggcacaagaggacatctaaccacctgctccttggaggaggcccccaggggtggtagaggctggaaggaagccacatcaggaggacgccactccggcccttcacccttgccaagtgagctgctcacagtgtggtcagggctgcgcgtgctggaggccctcctgcctgggccttgtggggcaaatattgggtccccaggctggaaagatggacagaggcccaatgggtgaaggctttgaagagcacacagaagcccctggccccccacgagagctggagagccatgtatatggcttcaaagccacctacggcagggacacactcgtgagcatgtgtggcctgcagttcaggtgatacatttaccagtgttcttgtttgtgtggtgccaggaaattgattttggaaaaagtgaaataacattaaaggtgaatgtgaggcttctacttttatccaaaaggagctatattagctaggctgtttctgatatccaatcattggtttaacaataaaggcaatttgtttaatcagttaacggaaatttcttggcttatgaaagtgaaaagtccagtggtattggcattggcagcaggtgagcaatttcacccagtgtcttctgcctccctctgcgttggtatctgctacatcccaggccaccacctccgaggatgaaaagatggctgcctgcagcttccacggaatccctccctcactgccagagcagcatcttctctgtgtaccacctctgctgtctcagatgcccccagcaaataaacactcttctcgttggtca

SEQ ID NO: 308564 - DNA, 2119 bp, Homo sapiens
tccagcgcgtgcccggggcggcggcgcgcggcggggggtggttggggtgcgcgccggcccgagtggacgccgtcgcgaccgccatgcagctgacggtgaaggcgctgcagggccgcgagtgcagcctgcaggtgccagaggacgagctggtgtccacgctgaagcagctggtctccgagaagctgaacgtcccagtgcgccagcagcggctgctgttcaagggcaaggccctggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcgtcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccgagtgacagccagccctggaaccccccgacccccgcagctgctgcagccagtgtgccagtgtgcgttcgacaaatggaaaagcagattggggccagggagtcagcaaggcaccccagctctgtgatgtgatcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtgggggcagaagcatgggctgggttccggttcatcctcctccaccctgccgtgtgtgtgggcacaagaggacatctaaccacctgctccttggaggaggcccccaggggtggtagaggctggaaggaagccacatcaggaggacgccactccggcccttcacccttgccaagtgagctgctcacagtgtggtcagggctgcgcgtgctggaggccctcctgcctgggccttgtggggcaaatattgggtccccaggctggaaagatggacagaggcccaatgggtgaaggctttgaagagcacacagaagcccctggccccccacgagagctggagagccatgtatatggcttcaaagccacctacggcagggacacactcgtgagcatgtgtggcctgcagttcaggtgatacatttaccagtgttcttgtttgtgtggtgccaggaaattgattttggaaaaagtgaaataacattaaaggtgaatgtgaggcttctacttttatccaaaaggagctatattagctaggctgtttctgatatccaatcattggtttaacaataaaggcaatttgtttaatcagttaacggaaatttcttggcttatgaaagtgaaaagtccagtggtattggcattggcagcaggtgagcaatttcacccagtgtcttctgcctccctctgcgttggtatctgctacatcccaggccaccacctccgaggatgaaaagatggctgcctgcagcttccacggaatccctccctcactgccagagcagcatcttctctgtgtaccacctctgctgtctcagatgcccccagcaaataaacactcttctcgttggtca

SEQ ID NO: 308565 - DNA, 2078 bp, Homo sapiens
tccagcgcgtgcccggggcggcggcgcgcggcggggggtggttggggtgcgcgccggcccgagtggacgccgtcgcgaccgccatgcagctgacggtgaaggcgctgcagggccgcgagtgcagcctgcaggtgccagaggacgagctggtgtccacgctgaagcagctggtctccgagaagctgaacgtcccagtgcgccagcagcggctgctgttcaagggcaaggccctggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacggttggccagccgcttcctgcaccctgaagtgactgagacaatggagaagggcttctccaaatagaattctcggagcatggggaggtgcccaacgccaggctaccgctgcatgtcgcactaagtgtgttctcctgttgcagttgggctcatcatcgtcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccgagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagcgtgacccagagatggggtgtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtggggacagaagcccctggccccccacgagagctggagagccatgtatatggcttcaaagccacctacggcagggacacactcgtgagcatgtgtggcctgcagttcaggtgatacatttaccagtgttcttgtttgtgtggtgccaggaaattgattttggaaaaagtgaaataacattaaaggtgaatgtgaggcttctacttttatccaaaaggagctatattagctaggctgtttctgatatccaatcattggtttaacaataaaggcaatttgtttaatcagttaacggaaatttcttggcttatgaaagtgaaaagtccagtggtattggcattggcagcaggtgagcaatttcacccagtgtcttctgcctccctctgcgttggtatctgctacatcccaggccaccacctccgaggatgaaaagatggctgcctgcagcttccacggaatccctccctcactgccagagcagcatcttctctgtgtaccacctctgctgtctcagatgcccccagcaaataaacactcttctcgttggtca

SEQ ID NO: 308566 - DNA, 2236 bp, Homo sapiens
tccagcgcgtgcccggggcggcggcgcgcggcggggggtggttggggtgcgcgccggcccgagtggacgccgtcgcgaccgccatgcagctgacggtgaaggcgctgcagggccgcgagtgcagcctgcaggtgccagaggacgagctggtgtccacgctgaagcagctggtctccgagaagctgaacgtcccagtgcgccagcagcggctgctgttcaagggcaaggccctggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggattacgagaggtccctgagtcgcctgacgctggacgacatcgaacgttgggctcatcatcgtcatagctggcatgtacctggctctggccaggtgctaggcactcctcacagcttgacctgggtttgcttccacaccctcagaagaggagagccggcacagcagaggcaccggcgatgaagtggcacagccccagtcggaatccagcggcttctgaaagtgccttggtgtgagaaggaggaaggggccgcttggagagctgggctctcgcatgtcatgtttagcccactgagaatataccctcaggtgactccctcccgatcctgaaagggaaagcagctgtcacctgacttctggcgggtccaacatagccctcagcttacctctgcaggaggccgagtgacagccagccctggaaccccccgacccccgcagctgctgcagccagtgtgccagtgtgcgttcgacaaatggaaaagcagattggggccagggagtcagcaaggcaccccagctctgtgatgtgactttgggcgagtctcagtgccacttggtccccagccatggactctatacagtgagggccactcaccgacctgagtcagtgtcctctgtctcacagggcccctctcccttctgttcagtaaacaaactgaagccaaaaatgaagccgtggccaagcgtgacccagagatggggtgtcctggcccttagtgacacagctcctctctggggcaccctatctgcttgtctcgtccaggaagcgttagggctgatgggtgactcagcaaggcagtgtcagagctgggactgggcgtaggcctttgtcctcatccccagcactggcctccctgtggaagatgaacatatcccagccacctgtgtacaggggctcactttgtgtgctccttgttgcctgagaagaaaccttggggtgccagggtgggggcagaagcatgggctgggttccggttcatcctcctccaccctgccgtgtgtgtgggcacaagaggacatctaaccacctgctccttggaggaggcccccaggggtggtagaggctggaaggaagccacatcaggaggacgccactccggcccttcacccttgccaagtgagctgctcacagtgtggtcagggctgcgcgtgctggaggccctcctgcctgggccttgtggggcaaatattgggtccccaggctggaaagatggacagaggcccaatgggtgaaggctttgaagagcacacagaagcccctggccccccacgagagctggagagccatgtatatggcttcaaagccacctacggcagggacacactcgtgagcatgtgtggcctgcagttcaggtgatacatttaccagtgttcttgtttgtgtggtgccaggaaattgattttggaaaaagtgaaataacattaaaggtgaatgtgaggcttctacttttatccaaaaggagctatattagctaggctgtttctgatatccaatcattggtttaacaataaaggcaatttgtttaatcagttaacggaaatttcttggcttatgaaagtgaaaagtccagtggtattggcattggcagcaggtgagcaatttcacccagtgtcttctgcctccctctgcgttggtatctgctacatcccaggccaccacctccgaggatgaaaagatggctgcctgcagcttccacggaatccctccctcactgccagagcagcatcttctctgtgtaccacctctgctgtctcagatgcccccagcaaataaacactcttctcgttggtca

SEQ ID NO: 308567 - DNA, 482 bp, Homo sapiens
gccggatgccgcagcgctccgctcccgccgcccgaggcggcctcgcgccccgggccacccccacggcggtggaggaggaggaacccatcgatctgtctttggcagatgggaaacgactctcggattatagcatcgggcccaactccaagctcaacctagtggtcaaacccctggagaaggtgctactagaagaaggcgaggcccagaggctggccgactccccacccccgcaggtctggcagctgatctccaaagtcttggcccgccacttcagtgcggcagatgccagcagggtcctggaacagctacagagggtgagaagggtaaccctgggcatcctcttcaggcccagttgctcccagcccctacctctgttgcagtgtatgccccccccccactggcagcccctgaatcttcctgcccttctctccccaggattacgagaggtccctgagtcgcctgacgctggacgacatcgaacg

SEQ ID NO: 308568 - DNA, 1294 bp, Homo sapiens
aaaaaagtgtgatctaattttattgctctgaaccgaatctctgtacattttattttatttaaaactaagtcgagctctatagaggctacatagcctccctcccattctggtcccacaccagactttgcatgggctctttctactatcagctttaaatagagaacgttcttgttctgttcatgaaggtttcataaatgctggagtccagtcataactagaactttacatatccgttccatcactgtatttttccagatccctggtaactccatagcgcggctctgttggggcgcatgcaattccctactttctcacagggggcgctgcagagaagggcagagcagagcgcgcggtcccagagcgcgccgtccaggagggggcgcgtccgtggggctgtgtctctgcgagccctgcgcaacgttgggggcgggaacaaccctggccctgcgcccgagcgctgcggcgccttgtgattggaggaggcaacggtcacttggcagcgccgttgggattgggggaagaggaccccggctggaggtgacgctgaggcggcgagggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccagagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtatgttagacattaaaataccagtcaaaaatgtttaatatgactagtcaatttcaggacctattctagaaaacatatctgagtaggatgaaggaaagagtgccttttaactgcaagtccagacagggtctccctatgtcaccaaggccggagtgcagtggttgcaatattggctcactgcagcctccacctcttgggctcaagtaatcctcctccatcagcctcccaagaagcttggactacaggggtgtgccaccatgccccgctaattttttttgtattttttgtagagacagggtttcgtcatgttgcccgggtctcgaactcctgagctcaagcaatctgcccaccttggcctccca

SEQ ID NO: 308569 - DNA, 4614 bp, Homo sapiens
cggtacccgaggatcccgatgtccctcccgggattttcctggacgggattgtgaagtagcggagatgtggtatggtgtattcctgtgggcactggtgtcttctctcttctttcatgtccctgctggattactggccctcttcaccctcagacatcacaaatatggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgactttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtggagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacgcctgtaatcccagcactttgggaggtcgatgtgggaggattgcttgagcccaagagttcaagactggcctgggcaacatggtgagaccttgtctctgctacaagataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattctaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctga

SEQ ID NO: 308570 - DNA, 5550 bp, Homo sapiens
aaaaaagtgtgatctaattttattgctctgaaccgaatctctgtacattttattttatttaaaactaagtcgagctctatagaggctacatagcctccctcccattctggtcccacaccagactttgcatgggctctttctactatcagctttaaatagagaacgttcttgttctgttcatgaaggtttcataaatgctggagtccagtcataactagaactttacatatccgttccatcactgtatttttccagatccctggtaactccatagcgcggctctgttggggcgcatgcaattccctactttctcacagggggcgctgcagagaagggcagagcagagcgcgcggtcccagagcgcgccgtccaggagggggcgcgtccgtggggctgtgtctctgcgagccctgcgcaacgttgggggcgggaacaaccctggccctgcgcccgagcgctgcggcgccttgtgattggaggaggcaacggtcacttggcagcgccgttgggattgggggaagaggaccccggctggaggtgacgctgaggcggcgagggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccaggtacggcccgccccgcgcctgcgcactgcgcgccccgccgtcgccgctgccgtgctgtgggcgccccgagtctgggcggggtcccgggtgcgcagcctgctggcggcgtgggacgctgtcctccgggaggggggccgtgctgctcgcccggagcccctttccccatcacttcttcggcggtccctgaggcggagccccggagtcccgctgggcgtgagatgcagagagcggccgcagagatgtggtatggtgtattcctgtgggcactggtgtcttctctcttctttcatgtccctgctggattactggccctcttcaccctcagacatcacaaatatggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgactttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtggagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacgcctgtaatcccagcactttgggaggtcgatgtgggaggattgcttgagcccaagagttcaagactggcctgggcaacatggtgagaccttgtctctgctacaagataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattctaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctga

SEQ ID NO: 308571 - DNA, 4481 bp, Homo sapiens
cggtacccgaggatcccgatgtccctcccgggattttcctggacgggattgtgaagtagcggagatgtggtatggtgtattcctgtgggcactggtgtcttctctcttctttcatgtccctgctggattactggccctcttcaccctcagacatcacaaatatggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgactttttttttttttttcttttaaatgagacggagcctcactgtgttgcccaggctggagtgcagtggtgcaatctcagctcactccaacctctgccacccgggttcaagcgattctcctgcctcagtttccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacgcctgtaatcccagcactttgggaggtcgatgtgggaggattgcttgagcccaagagttcaagactggcctgggcaacatggtgagaccttgtctctgctacaagataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattctaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctga

SEQ ID NO: 308572 - DNA, 5619 bp, Homo sapiens
aaaaaagtgtgatctaattttattgctctgaaccgaatctctgtacattttattttatttaaaactaagtcgagctctatagaggctacatagcctccctcccattctggtcccacaccagactttgcatgggctctttctactatcagctttaaatagagaacgttcttgttctgttcatgaaggtttcataaatgctggagtccagtcataactagaactttacatatccgttccatcactgtatttttccagatccctggtaactccatagcgcggctctgttggggcgcatgcaattccctactttctcacagggggcgctgcagagaagggcagagcagagcgcgcggtcccagagcgcgccgtccaggagggggcgcgtccgtggggctgtgtctctgcgagccctgcgcaacgttgggggcgggaacaaccctggccctgcgcccgagcgctgcggcgccttgtgattggaggaggcaacggtcacttggcagcgccgttgggattgggggaagaggaccccggctggaggtgacgctgaggcggcgagggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccaggtacggcccgccccgcgcctgcgcactgcgcgccccgccgtcgccgctgccgtgctgtgggcgccccgagtctgggcggggtcccgggtgcgcagcctgctggcggcgtgggacgctgtcctccgggaggggggccgtgctgctcgcccggagcccctttccccatcacttcttcggcggtccctgaggcggagccccggagtcccgctgggcgtgagatgcagagagcggccgcagagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgactttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtggagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacgcctgtaatcccagcactttgggaggtcgatgtgggaggattgcttgagcccaagagttcaagactggcctgggcaacatggtgagaccttgtctctgctacaagataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattctaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctga

SEQ ID NO: 308573 - DNA, 4719 bp, Homo sapiens
gctctctaattaccaccgctacaggctttctgaagggaggaggccaagttgggcggattgtttgagccgaggcattcaagaccagcctgggcaacacgagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgactttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtggagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacgcctgtaatcccagcactttgggaggtcgatgtgggaggattgcttgagcccaagagttcaagactggcctgggcaacatggtgagaccttgtctctgctacaagataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattctaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctga

SEQ ID NO: 308574 - DNA, 5382 bp, Homo sapiens
aaaaaagtgtgatctaattttattgctctgaaccgaatctctgtacattttattttatttaaaactaagtcgagctctatagaggctacatagcctccctcccattctggtcccacaccagactttgcatgggctctttctactatcagctttaaatagagaacgttcttgttctgttcatgaaggtttcataaatgctggagtccagtcataactagaactttacatatccgttccatcactgtatttttccagatccctggtaactccatagcgcggctctgttggggcgcatgcaattccctactttctcacagggggcgctgcagagaagggcagagcagagcgcgcggtcccagagcgcgccgtccaggagggggcgcgtccgtggggctgtgtctctgcgagccctgcgcaacgttgggggcgggaacaaccctggccctgcgcccgagcgctgcggcgccttgtgattggaggaggcaacggtcacttggcagcgccgttgggattgggggaagaggaccccggctggaggtgacgctgaggcggcgagggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccagagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgactttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtggagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacgcctgtaatcccagcactttgggaggtcgatgtgggaggattgcttgagcccaagagttcaagactggcctgggcaacatggtgagaccttgtctctgctacaagataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattctaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctga

SEQ ID NO: 308575 - DNA, 5327 bp, Homo sapiens
aaaaaagtgtgatctaattttattgctctgaaccgaatctctgtacattttattttatttaaaactaagtcgagctctatagaggctacatagcctccctcccattctggtcccacaccagactttgcatgggctctttctactatcagctttaaatagagaacgttcttgttctgttcatgaaggtttcataaatgctggagtccagtcataactagaactttacatatccgttccatcactgtatttttccagatccctggtaactccatagcgcggctctgttggggcgcatgcaattccctactttctcacagggggcgctgcagagaagggcagagcagagcgcgcggtcccagagcgcgccgtccaggagggggcgcgtccgtggggctgtgtctctgcgagccctgcgcaacgttgggggcgggaacaaccctggccctgcgcccgagcgctgcggcgccttgtgattggaggaggcaacggtcacttggcagcgccgttgggattgggggaagaggaccccggctggaggtgacgctgaggcggcgagggtgagtcggcgccggccgctaccgcacttcgggcgctcgtccctcatttctctgtggtgaatggcagcagatcctgagcctgaaggttgtgccgcgggtgggcaacgggaccctgtgccccaactctacttccctctgctccttcccagagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgactttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtggagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacgcctgtaatcccagcactttgggaggtcgatgtgggaggattgcttgagcccaagagttcaagactggcctgggcaacatggtgagaccttgtctctgctacaagataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattctaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctga

SEQ ID NO: 308576 - DNA, 4797 bp, Homo sapiens
cggtacccgaggatcccgatgtccctcccgggattttcctggacgggattgtgaagtagcggagatgtggtatggtgtattcctgtgggcactggtgtcttctctcttctttcatgtccctgctggattactggccctcttcaccctcagacatcacaaatatggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgactttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtggagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacgcctgtaatcccagcactttgggaggtcgatgtgggaggattgcttgagcccaagagttcaagactggcctgggcaacatggtgagaccttgtctctgctacaagataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattctaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctgagttggaattatatttctttttggtggctaatgagtttaatcttttgtaataaaattgacttcagttttcattttttaaataacttaatatctagcatgtgtaactttttttatgttctacttcttactaatttatgataaaattcttgttcaaagttgtgattaaaccgtacttaacatgtga

SEQ ID NO: 308577 - DNA, 5086 bp, Homo sapiens
taataaaaacaatcaatgacttgggagacaaaggaatccctgagtatctctcctctcatgccctgtgaatgaataacaactttatggcttagagtcctcctgtcttcccttttcacccctctagtccctcctccgtccatttcttgaagggaactatgagtgtgatagaaggtggagtggggattccctgtggcctgaaacatttcttgcttagtctaactcaaaagatcctttttcatttgttaccaaaaatgtattaggtccctgttgaaggctaggcatggggtaactggtaggggaatacagatatttttgagttcataatctggtcatgtgggaattgctatctttgtgattttgattatttcttccagattattttattcaataaatctaggagactctgggttttaaggagtcagcatctaaaagtgatcttgcaagccatgcaacgaatactcaaagtgtagagtagtccacagaaagaatagggaaaacctaacatttctgtaagatttaaatttcagtataaaatctggaacattctactcgcagtagtattttaaatgttgtattttcgtgagtttgttaaccttcgttttttgttttgtttaacattcttgcattttaaatcaggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttaatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgactttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtggagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacgcctgtaatcccagcactttgggaggtcgatgtgggaggattgcttgagcccaagagttcaagactggcctgggcaacatggtgagaccttgtctctgctacaagataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattctaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctga

SEQ ID NO: 308578 - DNA, 2827 bp, Homo sapiens
  misc_feature (39)..(39): n is a, c, g, or t
ggccgcgtcgacatctactgtgattctggagtctgcccnatttggaaaaaaaaaaaaaagaaaaaagtcaggaggaccaatttgccagggaaactcacagaaaagaattacaaagagatcacaaaaactggacatattcttttgactaattagaccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacgcctgtaatcccagcactttgggaggtcgatgtgggaggattgcttgagcccaagagttcaagactggcctgggcaacatggtgagaccttgtctctgctacaagataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattctaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcgtgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctga

SEQ ID NO: 308579 - DNA, 5197 bp, Homo sapiens
  misc_feature (130)..(130): n is a, c, g, or t
  misc_feature (151)..(151): n is a, c, g, or t
  misc_feature (154)..(154): n is a, c, g, or t
  misc_feature (217)..(217): n is a, c, g, or t
  misc_feature (219)..(219): n is a, c, g, or t
  misc_feature (241)..(241): n is a, c, g, or t
  misc_feature (382)..(382): n is a, c, g, or t
cgagcgcggcgcccttgagctgcaccgcggcgcaggtttgcgagccgacttgtcagccggccaagaaaaggaagctccgtcccttcccgctcacccggcttccccaccccttgtactctaaactctgcanagggcgagcggcgcggccacngangcgccgaggaggagcgagccgccgccgggcagcggcgtgccctcgggggagagggcgccgganangaggcggcggcgcggcggcganggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacganggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacata

SEQ ID NO: 308580 - DNA, 5143 bp, Homo sapiens
  misc_feature (130)..(130): n is a, c, g, or t
  misc_feature (151)..(151): n is a, c, g, or t
  misc_feature (154)..(154): n is a, c, g, or t
  misc_feature (217)..(217): n is a, c, g, or t
  misc_feature (219)..(219): n is a, c, g, or t
  misc_feature (241)..(241): n is a, c, g, or t
  misc_feature (382)..(382): n is a, c, g, or t
cgagcgcggcgcccttgagctgcaccgcggcgcaggtttgcgagccgacttgtcagccggccaagaaaaggaagctccgtcccttcccgctcacccggcttccccaccccttgtactctaaactctgcanagggcgagcggcgcggccacngangcgccgaggaggagcgagccgccgccgggcagcggcgtgccctcgggggagagggcgccgganangaggcggcggcgcggcggcganggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacganggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttcaaaacaagagccaagtcctgcggagaaagagatgtcaagggaattcggacactctttttgggcattccagatgagaattttgaagatcacagtgctcctccttcccctgaagaaaaagattctggattcttcatgctgaggaaggacagtgagaggcgagctacccttcacaggatcctgacggaagaccaagacataaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacata

SEQ ID NO: 308581 - DNA, 5135 bp, Homo sapiens
  misc_feature (130)..(130): n is a, c, g, or t
  misc_feature (151)..(151): n is a, c, g, or t
  misc_feature (154)..(154): n is a, c, g, or t
  misc_feature (217)..(217): n is a, c, g, or t
  misc_feature (219)..(219): n is a, c, g, or t
  misc_feature (241)..(241): n is a, c, g, or t
  misc_feature (382)..(382): n is a, c, g, or t
cgagcgcggcgcccttgagctgcaccgcggcgcaggtttgcgagccgacttgtcagccggccaagaaaaggaagctccgtcccttcccgctcacccggcttccccaccccttgtactctaaactctgcanagggcgagcggcgcggccacngangcgccgaggaggagcgagccgccgccgggcagcggcgtgccctcgggggagagggcgccgganangaggcggcggcgcggcggcganggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacganggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaagggtgacaatgtgttgattaatacctacagtggtgttctcaagatctctgacttcggaacatcaaagaggcttgctggcataaacccctgtactgaaacttttactggtaccctccagtatatggcaccagaaataatagataaaggaccaagaggctacggaaaagcagcagacatctggtctctgggctgtacaatcattgaaatggccacaggaaaacccccattttatgaactgggagaaccacaagcagctatgttcaaggtgggaatgtttaaagtccaccctgagatcccagagtccatgtctgcagaggccaaggcattcatactgaaatgttttgaaccagatcctgacaagagagcctgtgctaacgacttgcttgttgatgagtttttaaaagtttcaagcaaaaagaaaaagacacaacctaagctttcagctctttcagctggatcaaatgaatatctcaggagtatatccttgccggtacctgtgctggtggaggacaccagcagcagcagtgagtacggctcagtttcacccgacacggagttgaaagtggaccccttctctttccattccagatgagaattttgaagatcacagtgctcctccttcccctgaagaaaaagattctggattcttcatgctgaggaaggacagtgagaggcgagctacccttcacaggatcctgacggaagaccaagacaaaattgtgagaaacctaatggaatctttagctcagggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacata

SEQ ID NO: 308582 - DNA, 2170 bp, Homo sapiens
cagcccctcttggttgcaaggaactgacacaccgttaggacaactgaagtaccaaggacatgttataggtagacacgcatagcaataagggaagtagactcttaaggaattccaatcatagtgcctagccgagtctcacagacactgaaaacagaatatgagcctgaggaacttcaagtccccggagtttgcacatcttttctctggcttggttgctgttgacctgcttggtgtgcatttctgttcttgtccacttctcctctccctccctgatatggtttggctgtgtccccactcaaatctcatcttgaattgtaactcccacaattcccatgtgtcgtgggaggaacctggtgggaggtgattgaattatgggggcaggtctttcctgtgctgttcttgtgataatgaatgagtctcacaagatttgatgctttcaaaaaatgggagtttgcctgcacaagctctctctttttgcctgctgccatccaagtaagatgtgacttgctcctccttgccttctgccgtgattgtgaggcttccccagccacgtggaactggggctgaagaaccgaaactaaaatgggaacacatcacaaccctcattgcaagcctcagagaatttgtgagatccactgaccgaaaaatcatagccaccacactgtcaaagctgaaactggagctggacttcgacagccatggcattagccaagtccaggtggtactctttggttttcaagatgctgtcaataaagttcttcggaatcataacatcaagccgcactggatgtttgccttagacagtatcattcggaaggcggtacagacagccattaccatcctggttccagaactaaggccacatttcagccttgcatctgagagtgatactgctgatcaagaagacttggatgtagaagatgaccatgaggaacagccttcaaatcaaactgtccgaagacctcaggctgtcattgaagatgctgtggctacctcaggcgtgagcacgctcagttctactgtgtctcatgattcccagagtgctcaccggtcactgaatgtacagcttggaaggatgaaaatagaaaccaatagattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacata

SEQ ID NO: 308583 - DNA, 3972 bp, Homo sapiens
  misc_feature (130)..(130): n is a, c, g, or t
  misc_feature (151)..(151): n is a, c, g, or t
  misc_feature (154)..(154): n is a, c, g, or t
  misc_feature (217)..(217): n is a, c, g, or t
  misc_feature (219)..(219): n is a, c, g, or t
  misc_feature (241)..(241): n is a, c, g, or t
  misc_feature (382)..(382): n is a, c, g, or t
cgagcgcggcgcccttgagctgcaccgcggcgcaggtttgcgagccgacttgtcagccggccaagaaaaggaagctccgtcccttcccgctcacccggcttccccaccccttgtactctaaactctgcanagggcgagcggcgcggccacngangcgccgaggaggagcgagccgccgccgggcagcggcgtgccctcgggggagagggcgccgganangaggcggcggcgcggcggcganggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacganggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggggtgaagctaagtagtcttcttggtaaaaagggaaacttggaaaaactccagagctactgggaagttggattttttctgggggccagcgtcctagccaatgaccacatgagagtcattcaagcatctgaaaagctttttaaactgaagacaccagcatggtacctcaagtctattgtagagacaattttaatatataagcattttgtgaaactgaccacagaacagcctgtggccaagcaagaacttgtggacttttggatggatttcctggtcgaggccacaaagacagatgttactgtggttaggtttccagtattaatattagaaccaaccaaaatctatcaaccttcttatttgtctatcaacaatgaagttgaggaaaagacaatctctatttggcacgtgcttcctgatgacaagaaaggtatacatgagtggaattttagtgcctcttctgtcaggggagtgagtatttctaaatttgaagaaagatgctgctttctttatgtgcttcacaattctgatgatttccaaatctatttctgtacagaacttcattgtaaaaagttttttgagatggtgaacaccattaccgaagagaaggggagaagcacagaggaaggagactgtgaaagtgacttgctggagtatgactatgaatatgatgaaaatggtgacagagtcgttttaggaaaaggcacttatgggatagtctacgcaggtcgggacttgagcaaccaagtcagaattgctattaaggaaatcccagagagagacagcagatactctcagcccctgcatgaagaaatagcattgcataaacacctgaagcacaaaaatattgtccagtatctgggctctttcagtgagaatggtttcattaaaatcttcatggagcaggtccctggaggaagtctttctgctctccttcgttccaaatggggtccattaaaagacaatgagcaaacaattggcttttatacaaagcaaatactggaaggattaaaatatctccatgacaatcagatagttcaccgggacataaaggtaccctccagtatatggcaccagaaataatagataaaggaccaagaggctacggaaaagcagcagacatctggtctctgggctgtacaatcattgaaatggccacaggaaaacccccattattactggaagaattggttcggaaagagaaagaattacaagcactccttcatcgagctattgaagaaaaagaccaagaaattaaacacctgaagcttaagtcccaacccatagaaattcctgaattgcctgtatttcatctaaattcttctggcacaaatactgaagattctgaacttaccgactggctgagagtgaatggagctgatgaagacactataagccggtttttggctgaagattatacactattggatgttctctactatgttacacgtgatgacttaaaatgcttgagactaaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacata

SEQ ID NO: 308584 - DNA, 1328 bp, Homo sapiens
tggagtctcactctgtcacccaggctggagtgcagtggcgtgatctcagctcactgcaagctccgcctcccaggttcacgccgttctcctgcctcagcctcccaagtagctgggactataggcgcccaccaccacgcccagctaatttttttgtatttttagtagagacggggtttcactgtgttagccaggatggtctcgatctcctgaccacgtgatctgcctgcctcggccttctaaagtgctgggattacaggcatgcgccaccgcgcccagcccaagcataaaactattatacccaccattataaagacaaatttcaaaaatgctgaaactctaaaatgatgttttgggacatagcagtttgtgggagtgaaaagggaaggaatggagggaagatgagaaaaaatatacaaaaagaatacataataactgatcagactttgggatcttcttctgaccagagcagatgaaagctaagaagtcacttttctatttcaagggcaatgtttcaaatgaaatgttcgtttcaccatgttcttgtgtctttaaacaggggagggatgctgtgcacactgtggaaggctatcattgactttcgaaacaaacagacttgactgttgctcaatctaatcttcgatggaaattctaaaaattaatacagagctgatcttcttgggggtgggaaaatcgaagggagaggagaaaggcgctgcactttaaatccagtatttgtttactcatgttaaaaaaaaaaaaaacagacaaaacacactgaaatttcctaactacatctatttctataatttttaaggactcttcataaggactcttaaaataatcctgaacattagaaccctaatgttcaggaagattttaatctaagcatttttatggaaatatttttaatgcagcagctattgcacttcagccaaatgtttatttcacacaaaacggatgtaacatttcatgtgatcgtgcaccactggaacaaaaccaaaatgtgaccataactgtttaggcttctgtgtgtttgtaatatgctctaataatctgagtagaaatgcgtaatttcaattactgtataaagtttatgtttttttaagtgtgcagaatctgagagcaatggtttttacttctctgtgttaattgtaatattgactctattttgtaacttaagtttctgacctgtcgtacatttgtttgagtcgtttatgtactactgaactgtaccagttgcacatgcttgaactgtagtaatgttagcttgttctaaagctatccattgtgtcatatttactctaaaaattaaagagactctcaacata

SEQ ID NO: 308585 - DNA, 1848 bp, Homo sapiens
  misc_feature (130)..(130): n is a, c, g, or t
  misc_feature (151)..(151): n is a, c, g, or t
  misc_feature (154)..(154): n is a, c, g, or t
  misc_feature (217)..(217): n is a, c, g, or t
  misc_feature (219)..(219): n is a, c, g, or t
  misc_feature (241)..(241): n is a, c, g, or t
  misc_feature (382)..(382): n is a, c, g, or t
cgagcgcggcgcccttgagctgcaccgcggcgcaggtttgcgagccgacttgtcagccggccaagaaaaggaagctccgtcccttcccgctcacccggcttccccaccccttgtactctaaactctgcanagggcgagcggcgcggccacngangcgccgaggaggagcgagccgccgccgggcagcggcgtgccctcgggggagagggcgccgganangaggcggcggcgcggcggcganggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacganggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttggttcaaaaaggcatttgaatctgagccaacactacagtcaggaattaattatgcggtcctcctcctggcagctggacaccagtttgaatcttcctttgagctccggaaagttggtaattacaacttgatattttacatggaaatcaagaaactggacccaacttggtgcaaagaaaaagaatcatgaatagataaatcttttgctttctgtcttttcatacttcccaaagagaa

SEQ ID NO: 308586 - DNA, 1785 bp, Homo sapiens
  misc_feature (130)..(130): n is a, c, g, or t
  misc_feature (151)..(151): n is a, c, g, or t
  misc_feature (154)..(154): n is a, c, g, or t
  misc_feature (217)..(217): n is a, c, g, or t
  misc_feature (219)..(219): n is a, c, g, or t
  misc_feature (241)..(241): n is a, c, g, or t
  misc_feature (382)..(382): n is a, c, g, or t
cgagcgcggcgcccttgagctgcaccgcggcgcaggtttgcgagccgacttgtcagccggccaagaaaaggaagctccgtcccttcccgctcacccggcttccccaccccttgtactctaaactctgcanagggcgagcggcgcggccacngangcgccgaggaggagcgagccgccgccgggcagcggcgtgccctcgggggagagggcgccgganangaggcggcggcgcggcggcganggcgcggcgcgcgatggcagctgcttagcccggcgggcgcggagcagccccgagctgtggctggccaggcggtgcggctgggcgggggacgccgccgccgttgctgcccggcccggagagatgagcacggaggcggacganggcatcactttctctgtgccacccttcgccccctcgggcttctgcaccatccccgagggcggcatctgcaggaggggaggagcggcggcggtgggcgagggcgaggagcaccagctgccaccgccgccgccgggcagcttctggaacgtggagagcgccgctgcccctggcatcggttgtccggcggccacctcctcgagcagtgccacccgaggccggggcagctctgttggcgggggcagccgacggaccacggtggcatatgtgatcaacgaagcgagccaagggcaactggtggtggccgagagcgaggccctgcagagcttgcgggaggcgtgcgagacagtgggcgccaccctggaaaccctgcattttgggaaactcgactttggagaaaccaccgtgctggaccgcttttacaatgcagatattgcggtggtggagatgagcgatgccttccggcagccgtccttgttttaccaccttggggtgagagaaagtttcagcatggccaacaacatcatcctctactgtgatactaactcggactctctgcagtcactgaaggaaataatttgccagaagaatactatgtgcactgggaactacacctttgttccttacatgataactccacataacaaagtctactgctgtgacagcagcttcatgaaggggttgacagagctcatgcaaccgaacttcgagctgcttcttggacccatctgcttacctcttgtggatcgttttattcaacttttgaaggtggcacaagcaagttctagccagtacttccgggaatctatactcaatgacatcaggaaagctcgtaatttatacactggtaaagaattggcagctgagttggcaagaattcggcagcgagtagataatatcgaagtcttgacagcagatattgtcataaatctgttactttcctacagagatatccaggactatgattctattgtgaagctggtagagactttagaaaaactgccaacctttgatttggcctcccatcaccatgtgaagtttcattatgcatttgcactgaataggagaaatctccctggtgacagagcaaaagctcttgatattatgattcccatggtgcaaagcgaaggacaagttgcttcagatatgtattgcctagttggtcgaatctacaaagatatgtttttggactctaatttcacggacactgaaagcagagaccatggagcttcttgatattgcggtggtggagatgaacgatgccttccggcagccgtccttgttttaccaccttggggtgagagaaagtttcagcatggccaacaacatcatcctctactgtgatactaactcggactctctgcagtcactgaagattgtaactttttagccggtaaggatcgcta

SEQ ID NO: 308587 - DNA, 627 bp, Homo sapiens
ttttaattatagtcaaggtttacattatgaatagagtttgtgctttattaaagttatataaaacatcttttgtgcatattctactttctctacagtttttggctgaagattatacactattggatgttctctactatgttacacgtgatgacttaaaatgcttgagactaaggtaccacttttctttctgttgtcactatggaaagagcaccaggcaaatatcaaaaagtctgagtatcttcccaggctgggtctctaattagctttgtagttctggacagagctctctagctcttagctgctctgagtaaactgagttagttggacaatgatatttttgagggctctaataaccaatatttctatattagtaagtgaaaatcaactggaagaatttttttgaataagatgcagactaagtccatgcagatattctgaagctgccttaaacaaatgctttaattgagttcatgatggtgttatactcaataaatatttggaggaggtgctgacttgccctccaaaaacctggtataatctgatataatttcttgttaattaaggccaagcatataactttttttttttttttcgggatggagtctcactctgtcacccaggctggag

SEQ ID NO: 308588 - DNA, 2836 bp, Homo sapiens
cacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcag

SEQ ID NO: 308589 - DNA, 585 bp, Homo sapiens
agtttttttcaaatttcccaagataaactctgtaatgaatctgccctttagacctggcatgcacccaggttatgtgtcctgatgtggggcttcacaaacatggtctctgtacatttacagcacctggccagcctgtgaccctcagtggcccttgctggcagctgcactgaaatgctgtattagaggcctctggatcctgtatgttctatgcaaggttctcacgggtcctccctccagaaatgcctcgactgggcagaatggaaggagccccaggtggcagagggcagggtgctggcagaattgggaacacctggagaggacataaggtggggttggagtccttttctgccttcacgtggttatccactcgctctcttcccatagagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgagagccagcaagcacaggcagaaggcgggcagggggaggtgggagtgggaa

SEQ ID NO: 308590 - DNA, 2812 bp, Homo sapiens
aatggcaggctggtccggcccgagatttaggattgaaggactgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcag

SEQ ID NO: 308591 - DNA, 2766 bp, Homo sapiens
aatggcaggctggtccggcccgagatttaggattgaaggactgctctgcacgcacctatgtggaaactaaagcccagagagaaagtctgacttgccccacagccagtgagtgactgcagcagcaccagaatctgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcag

SEQ ID NO: 308592 - DNA, 3204 bp, Homo sapiens
cacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcagaccacagctgtcactttgctttacctcatcaaggccaaagcagactgtttatagcctgggcctcgggaaagctcttgtccatcctcctcttgccacctgagggcagggagaggtgcccaagcgcgaatgtgcaggaaactcccggggtgcaccctgggacccaggaagccaggtctggaaagggcctatgaattctcaagtgctgcggatgcaggggggtcccaggtcagagacactgcatctgttggtgtctagcctccttccgtcctgctgcgtgtgctttttcgtcttgctcagaactgatgccctgtttttgctcctacttgcttgttcctctgtggagaaggggttttaaaatggcttatagg

SEQ ID NO: 308593 - DNA, 2220 bp, Homo sapiens
agtttttttcaaatttcccaagataaactctgtaatgaatctgccctttagacctggcatgcacccaggttatgtgtcctgatgtggggcttcacaaacatggtctctgtacatttacagcacctggccagcctgtgaccctcagtggcccttgctggcagctgcactgaaatgctgtattagaggcctctggatcctgtatgttctatgcaaggttctcacgggtcctccctccagaaatgcctcgactgggcagaatggaaggagccccaggtggcagagggcagggtgctggcagaattgggaacacctggagaggacataaggtggggttggagtccttttctgccttcacgtggttatccactcgctctcttcccatagagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcagaccacagctgtcactttgctttacctcatcaaggccaaagcagactgtttatagcctgggcctcgggaaagctcttgtccatcctcctcttgccacctgagggcagggagaggtgcccaagcgcgaatgtgcaggaaactcccggggtgcaccctgggacccaggaagccaggtctggaaagggcctatgaattctcaagtgctgcggatgcaggggggtcccaggtcagagacactgcatctgttggtgtctagcctccttccgtcctgctgcgtgtgctttttcgtcttgctcagaactgatgccctgtttttgctcctacttgcttgttcctctgtggagaaggggttttaaaatggcttatagg

SEQ ID NO: 308594 - DNA, 2760 bp, Homo sapiens
cacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggttttggttcctttgtggacaaaacggtgctgccctttgtgagcacagtaccctccaaactgcgccacccctgccccacccggctggagcgctgccagtcaccattcagctttcaccatgtgctgtccctgacgggggacgcacaagccttcgagcgggaggtggggcgccagagtgtgtccggcaatctggactcgcctgaaggtggcttcgatgccattctgcaggctgcactctgccaggagcagattggctggagaaatgtgtcccggctgctggtgttcacttcagacgacacattccatacagctggggacgggaagttgggcggcattttcatgcccagtgatgggcactgccacttggacagcaatggcctctacagtcgcagcacagagtttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcagaccacagctgtcactttgctttacctcatcaaggccaaagcagactgtttatagcctgggcctcgggaaagctcttgtccatcctcctcttgccacctgagggcagggagaggtgcccaagcgcgaatgtgcaggaaactcccggggtgcaccctgggacccaggaagccaggtctggaaagggcctatgaattctcaagtgctgcggatgcaggggggtcccaggtcagagacactgcatctgttggtgtctagcctccttccgtcctgctgcgtgtgctttttcgtcttgctcagaactgatgccctgtttttgctcctacttgcttgttcctctgtggagaaggggttttaaaatggcttatagg

SEQ ID NO: 308595 - DNA, 2084 bp, Homo sapiens
ctctacagtcgcagtgcccatcactgggcatgaaaatgcctctacagtcgcagcacagagttgactacccttctgtgggtcaggtagcccaggccctctctgcagcaaatatccagcccatctttgctgtcaccagtgccgcactgcctgtctaccaggagctgagtaaactgattcctaagtctgcagttggggagctgagtgaggactccagcaacgtggtacagctcatcatggatgcttataatagcctgtcttccaccgtgacccttgaacactcttcactccctcctggggtccacatttcttacgaatcccagtgtgagggtcctgagaagagggagggtaaggctgaggatcgaggacagtgcaaccacgtccgaatcaaccagacggtgactttctgggtttctctccaagccacccactgcctcccagagccccatctcctgaggctccgggcccttggcttctcagaggagctgattgtggagttgcacacgctgtgtgactgtaattgcagtgacacccagccccaggctccccactgcagtgatggccagggacacctacaatgtggtgtatgcagctgtgcccctggccgcctaggtcggctctgtgagtgctctgtggcagagctgtcctccccagacctggaatctgggtgccgggctcccaatggcacagggcccctgtgcagtggaaagggtcactgtcaatgtggacgctgcagctgcagtggacagagctctgggcatctgtgcgagtgtgacgatgccagctgtgagcgacatgagggcatcctctgcggaggctttggtcgctgccaatgtggagtatgtcactgtcatgccaaccgcacgggcagagcatgcgaatgcagtggggacatggacagttgcatcagtcccgagggagggctctgcagtgggcatggacgctgcaaatgcaaccgctgccagtgcttggacggctactatggtgctctatgcgaccaatgcccaggctgcaagacaccatgcgagagacaccgggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttcttggtggaggatgacgccagaggcacggtcgtgctcagagtgagaccccaagaaaagggagcagaccacacgcaggccattgtgctgggctgcgtagggggcatcgtggcagtggggctggggctggtcctggcttaccggctctcggtggaaatctatgaccgccgggaatacagtcgctttgagaaggagcagcaacaactcaactggaagcaggacagtaatcctctctacaaaagtgccatcacgaccaccatcaatcctcgctttcaagaggcagacagtcccactctctgaaggagggagggacacttacccaaggctcttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcagaccacagctgtcactttgctttacctcatcaaggccaaagcagactgtttatagcctgggcctcgggaaagctcttgtccatcctcctcttgccacctgagggcagggagaggtgcccaagcgcgaatgtgcaggaaactcccggggtgcaccctgggacccaggaagccaggtctggaaagggcctatgaattctcaagtgctgcggatgcaggggggtcccaggtcagagacactgcatctgttggtgtctagcctccttccgtcctgctgcgtgtgctttttcgtcttgctcagaactgatgccctgtttttgctcctacttgcttgttcctctgtggagaaggggttttaaaatggcttatagg

SEQ ID NO: 308596 - DNA, 832 bp, Homo sapiens
cacttcctcctctgccgtctcccagatcagtacacaaaggctgctgctgccgccagaggaaggactgctctgcacgcacctatgtggaaactaaagcccagagagaaagtctgacttgccccacagccagtgagtgactgcagcagcaccagaatctggtctgtttcctgtttggctcttctaccactacggcttgggatctcgggcatggtggctttgccaatggtccttgttttgctgctggtcctgagcagaggtgagagtgaattggacgccaagatcccatccacaggggatgccacagaatggcggaatcctcacctgtccatgctggggtcctgccagccagccccctcctgccagaagtgcatcctctcacaccccagctgtgcatggtgcaagcaactgaacttcaccgcgtcgggagaggcggaggcgcggcgctgcgcccgacgagaggagctgctggctcgaggctgcccgctggaggagctggaggagccccgcggccagcaggaggtgctgcaggaccagccgctcagccagggcgcccgcggagagggtgccacccagctggcgccgcagcgggtccgggtcacgctgcggcctggggagccccagcagctccaggtccgcttccttcgtgctgagggatacccggtggacctgtactaccttatggacctgagctactccatgaaggacgacctggaacgcgtgcgccagctcgggcacgctctgctggtccggctgcaggaagtcacccattctgtgcgcattggtgagccgagcgctgcctcccgccctgttagcccttgcctattcaaccact

SEQ ID NO: 308597 - DNA, 330 bp, Homo sapiens
agacaccatgcgagagacaccggtgaggcctcaggtcttgcatcttgggagcaggggcacagtggggcttgttgagctactcccatctgcctactctccgtcctgcttgtagttgggcaaggggcattgggtgacaactgcccagctggtaacctattggcatctactacacagggactgtgcagagtgtggggccttcaggactggcccactggccaccaactgcagtacagcttgtgcccataccaatgtgaccctggccttggcccctatcttggatgatggctggtgcaaagagcggaccctggacaaccagctgttcttcttctt

SEQ ID NO: 308598 - DNA, 1305 bp, Homo sapiens
cctgagtcccgggaggaaagtgctcgcccgttcctgacctgtgacacgctcactgcgaaggcaggttattagaagagtcccatgaaaggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagatgtgtgccaagcttctaatctgcttcctgcattgaggtctttaaactgttgtctaccttccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaa

SEQ ID NO: 308599 - DNA, 1065 bp, Homo sapiens
atgaagatatctaggggcagagtgtgcttggagtcagagaacaaggacgctggtgtggctggtcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaa

SEQ ID NO: 308600 - DNA, 624 bp, Homo sapiens
taaacaaaacagaaatttctatttattgtaaaattgagtcaagaatagatagcaaaaaacattgaggagtacgtgctataatatgatgaagaatagagaggacagacctctgataagaaggggatcttaagggtaaagagagtgctggaaatcactacatagcaacttttattaatgcctccaaatactcagatttgtactataaactattctacatgttttcaaaactattgtaataaaatttaaagaatgacttcattttatctatcttttcagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaa

SEQ ID NO: 308601 - DNA, 507 bp, Homo sapiens
agggtattaaaacggatccttaaaaatgaaagtgcaggctgaaagttggtagtgtgggaggtagagggtgtgtgttcttgtgcagaggagcgtggggtttgcagaggagacaggggagctttgtgtacccggagcaatgaacaagcggcgacttctctacccctcagggtggctccacggtcccagcgacatgcaggggctcctcttctccactcttctgcttgctggcctggcacaggtaatggcaccgaagcctcctttcgctatgtttgaacagcgccacgctttcctatatatttttatagcagagcctaaggcacagcctggcacagtgcgggaaacagtgtctctccatgccagctccaggcggaggctcaactttccattgctgtttgcaaaatgtgcaaagagcccctggaaaaacgaattttgacagcgactttttccagttaagtctgtccttctttgaaaggggcactttggaataaacatttacatttttaaaac

SEQ ID NO: 308602 - DNA, 400 bp, Homo sapiens
cctgagtcccgggaggaaagtgctcgcccgttcctgacctgtgacacgctcactgcgaagggtggctccacggtcccagcgacatgcaggggctcctcttctccactcttctgcttgctggcctggcacaggtaatggcaccgaagcctcctttcgctatgtttgaacagcgccacgctttcctatatatttttatagcagagcctaaggcacagcctggcacagtgcgggaaacagtgtctctccatgccagctccaggcggaggctcaactttccattgctgtttgcaaaatgtgcaaagagcccctggaaaaacgaattttgacagcgactttttccagttaagtctgtccttctttgaaaggggcactttggaataaacatttacatttttaaaac

SEQ ID NO: 308603 - DNA, 1321 bp, Homo sapiens
agggtattaaaacggatccttaaaaatgaaagtgcaggctgaaagttggtagtgtgggaggtagagggtgtgtgttcttgtgcagaggagcgtggggtttgcagaggagacaggggagctttgtgtacccggagcaatgaacaagcggcgacttctctacccctcagggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaa

SEQ ID NO: 308604 - DNA, 1241 bp, Homo sapiens
cctgagtcccgggaggaaagtgctcgcccgttcctgacctgtgacacgctcactgcgaaggcaggttattagaagagtcccatgaaaggtggctccacggtcccagcgacatgcaggggctcctcttctccactcttctgcttgctggcctggcacagttctgctgcagggtacagggcactggaccattagatacaacacctgaaggaaggcctggagaagtgtcagatgcacctcagcgtaaacagttttgtcactggccctgcaaatgccctcagcagaagccccgttgccctcctggagtgagcctggtgagagatggctgtggatgctgtaaaatctgtgccaagcaaccaggggaaatctgcaatgaagctgacctctgtgacccacacaaagggctgtattgtgactactcagtagacaggcctaggtacgagactggagtgtgtgcataccttgtagctgttgggtgcgagttcaaccaggtacattatcataatggccaagtgtttcagcccaaccccttgttcagctgcctctgtgtgagtggggccattggatgcacacctctgttcataccaaagctggctggcagtcactgctctggagctaaaggtggaaagaagtctgatcagtcaaactgtagcctggaaccattactacagcagctttcaacaagctacaaaacaatgccagcttatagaaatctcccacttatttggaaaaaaaaatgtcttgtgcaagcaacaaaatggactccctgctccagaacatgtgggatgggaatatctaacagggtgaccaatgaaaacagcaactgtgaaatgagaaaagagaaaagactgtgttacattcagccttgcgacagcaatatattaaagacaataaagattcccaaaggaaaaacatgccaacctactttccaactctccaaagctgaaaaatttgtcttttctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaa

SEQ ID NO: 308605 - DNA, 481 bp, Homo sapiens
tctggatgctcaagtactcagagttacaaacccactttttgtggaatatgcttggataagagatgctgtatccctaataagtctaaaatgattactattcaatttgattgcccaaatgaggggtcatttaaatggaagatgctgtggattacatcttgtgtgtgtcagagaaactgcagagaacctggagatatattttctgagctcaagattctgtaaaaccaagcaaatgggggaaaagttagtcaatcctgtcatataataaaaaaattagtgagtataaaatggtggcaaatctactttgtttaaaacagtatgaatgcctattctcagatcactacatttaaggcattagaaacttttaaaaagttatcttaaaaatatacataaaatttgaacaacttaaaaattgaactaatttctaaaatatatcctataattatataatacacagacatttgttaccatctaagcattttgt

SEQ ID NO: 308606 - DNA, 1888 bp, Homo sapiens
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtcccgaattcagttggtttaatatattgtcctctgtaatttcgatccttcttaa

SEQ ID NO: 308607 - DNA, 615 bp, Homo sapiens
cttaacttctcatagctgatgaatatgaattttcagataggaagggcgcactgagaacccagccatagtgaataaaaacagatctatggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttct

SEQ ID NO: 308608 - DNA, 521 bp, Homo sapiens
tcacggtagatatctagggtaagagggaaagctagcaatcccacaatgatttcctttatttcttgccatccgaatatattcttcttcaccaatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttct

SEQ ID NO: 308609 - DNA, 979 bp, Homo sapiens
ttgacatattcaatatgtcaaagtgctgtattttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaaaaaaaaaaaaaaaaaacacaaaaaaaaaaaaataaaaaaaaaagaacacaacaaacaacaaaaaaaaaaaaaaaaaaaaaaaaaaaaagaggggggggcgcccaaagagatatcccctcggggggccccacattgagcgcccccgctgtttttagtgacaaagggtgggcgcctactcaaagtggggaggcgttatataaactaggaggcgggcgcgcgctataaaacaagcacgaggtacgtgagggaacaactggtgtacttgagagaagttatatggatagagaagcaccctctttctatgggctgtggggtgataacaataaatagagtaggacagcaaaaacaatctaacacatcagaaggataaaatgtaataccccgcacctcacacgaactaggccgaacaaatatataaaaacataaattcttgacggcgcatcaaatatattagtaggtgcgcaacaaccacactaccatattcaaatctacttcccgcgcaagtccggtacacaaaacattatagtcgcttatgcaagctgactaaacaactacatcttagcacaaccacctaataatttttccaccg

SEQ ID NO: 308610 - DNA, 1922 bp, Homo sapiens
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttct

SEQ ID NO: 308611 - DNA, 1796 bp, Homo sapiens
  misc_feature (32)..(32): n is a, c, g, or t
  misc_feature (36)..(36): n is a, c, g, or t
ggcagtactcctacggtcttaggtacgaggcngggngtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttct

SEQ ID NO: 308612 - DNA, 4109 bp, Homo sapiens
  misc_feature (2119)..(2120): n is a, c, g, or t
  misc_feature (2126)..(2126): n is a, c, g, or t
  misc_feature (2280)..(2280): n is a, c, g, or t
  misc_feature (2293)..(2293): n is a, c, g, or t
  misc_feature (2296)..(2296): n is a, c, g, or t
  misc_feature (2298)..(2298): n is a, c, g, or t
  misc_feature (2303)..(2303): n is a, c, g, or t
  misc_feature (2361)..(2361): n is a, c, g, or t
  misc_feature (2366)..(2367): n is a, c, g, or t
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308613 - DNA, 4228 bp, Homo sapiens
  misc_feature (2119)..(2120): n is a, c, g, or t
  misc_feature (2126)..(2126): n is a, c, g, or t
  misc_feature (2280)..(2280): n is a, c, g, or t
  misc_feature (2293)..(2293): n is a, c, g, or t
  misc_feature (2296)..(2296): n is a, c, g, or t
  misc_feature (2298)..(2298): n is a, c, g, or t
  misc_feature (2303)..(2303): n is a, c, g, or t
  misc_feature (2361)..(2361): n is a, c, g, or t
  misc_feature (2366)..(2367): n is a, c, g, or t
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttctcttgctaatctctcttttgttatagagatctcagccctaaacctaggatggatagaaggaaacatatgttctcccctacattagtaaaaataaaaatggaattttttacccatacaaa

SEQ ID NO: 308614 - DNA, 3270 bp, Homo sapiens
  misc_feature (2119)..(2120): n is a, c, g, or t
  misc_feature (2126)..(2126): n is a, c, g, or t
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttctcttgctaatctctcttttgttatagagatctcagccctaaacctaggatggatagaaggaaacatatgttctcccctacattagtaaaaataaaaatggaattttttacccatacaaa

SEQ ID NO: 308615 - DNA, 3923 bp, Homo sapiens
  misc_feature (1933)..(1934): n is a, c, g, or t
  misc_feature (1940)..(1940): n is a, c, g, or t
  misc_feature (2094)..(2094): n is a, c, g, or t
  misc_feature (2107)..(2107): n is a, c, g, or t
  misc_feature (2110)..(2110): n is a, c, g, or t
  misc_feature (2112)..(2112): n is a, c, g, or t
  misc_feature (2117)..(2117): n is a, c, g, or t
  misc_feature (2175)..(2175): n is a, c, g, or t
  misc_feature (2180)..(2181): n is a, c, g, or t
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308616 - DNA, 3968 bp, Homo sapiens
  misc_feature (1978)..(1979): n is a, c, g, or t
  misc_feature (1985)..(1985): n is a, c, g, or t
  misc_feature (2139)..(2139): n is a, c, g, or t
  misc_feature (2152)..(2152): n is a, c, g, or t
  misc_feature (2155)..(2155): n is a, c, g, or t
  misc_feature (2157)..(2157): n is a, c, g, or t
  misc_feature (2162)..(2162): n is a, c, g, or t
  misc_feature (2220)..(2220): n is a, c, g, or t
  misc_feature (2225)..(2226): n is a, c, g, or t
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtataaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308617 - DNA, 4230 bp, Homo sapiens
  misc_feature (2240)..(2241): n is a, c, g, or t
  misc_feature (2247)..(2247): n is a, c, g, or t
  misc_feature (2401)..(2401): n is a, c, g, or t
  misc_feature (2414)..(2414): n is a, c, g, or t
  misc_feature (2417)..(2417): n is a, c, g, or t
  misc_feature (2419)..(2419): n is a, c, g, or t
  misc_feature (2424)..(2424): n is a, c, g, or t
  misc_feature (2482)..(2482): n is a, c, g, or t
  misc_feature (2487)..(2488): n is a, c, g, or t
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtgatggagtcttgctctgttgccaggctggagtgaggtggcacgatctcagctcactgcaacctctgcctcctgggttcaagcaattctcctgcctcagcctcctgagtagctgggactacaggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308618 - DNA, 2448 bp, Homo sapiens
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttctcttgctaatctctcttttgttatagagatctcagccctaaacctaggatggatagaaggaaacatatgttctcccctacattagtaaaaataaaaatggaattttttacccatacaaa

SEQ ID NO: 308619 - DNA, 4056 bp, Homo sapiens
  misc_feature (2066)..(2067): n is a, c, g, or t
  misc_feature (2073)..(2073): n is a, c, g, or t
  misc_feature (2227)..(2227): n is a, c, g, or t
  misc_feature (2240)..(2240): n is a, c, g, or t
  misc_feature (2243)..(2243): n is a, c, g, or t
  misc_feature (2245)..(2245): n is a, c, g, or t
  misc_feature (2250)..(2250): n is a, c, g, or t
  misc_feature (2308)..(2308): n is a, c, g, or t
  misc_feature (2313)..(2314): n is a, c, g, or t
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308620 - DNA, 3943 bp, Homo sapiens
  misc_feature (1953)..(1954): n is a, c, g, or t
  misc_feature (1960)..(1960): n is a, c, g, or t
  misc_feature (2114)..(2114): n is a, c, g, or t
  misc_feature (2127)..(2127): n is a, c, g, or t
  misc_feature (2130)..(2130): n is a, c, g, or t
  misc_feature (2132)..(2132): n is a, c, g, or t
  misc_feature (2137)..(2137): n is a, c, g, or t
  misc_feature (2195)..(2195): n is a, c, g, or t
  misc_feature (2200)..(2201): n is a, c, g, or t
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308621 - DNA, 3925 bp, Homo sapiens
  misc_feature (1935)..(1936): n is a, c, g, or t
  misc_feature (1942)..(1942): n is a, c, g, or t
  misc_feature (2096)..(2096): n is a, c, g, or t
  misc_feature (2109)..(2109): n is a, c, g, or t
  misc_feature (2112)..(2112): n is a, c, g, or t
  misc_feature (2114)..(2114): n is a, c, g, or t
  misc_feature (2119)..(2119): n is a, c, g, or t
  misc_feature (2177)..(2177): n is a, c, g, or t
  misc_feature (2182)..(2183): n is a, c, g, or t
gcccaccggcgcgctgagtctagttaccatcacaccccgggaggagtcgtagttgtctgcagccggccccagtctagcgcatcgacgctgcaatcagtgagtcagcgatggtcgcgagagccagcgagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308622 - DNA, 1781 bp, Homo sapiens
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtataaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttct

SEQ ID NO: 308623 - DNA, 4055 bp, Homo sapiens
  misc_feature (2065)..(2066): n is a, c, g, or t
  misc_feature (2072)..(2072): n is a, c, g, or t
  misc_feature (2226)..(2226): n is a, c, g, or t
  misc_feature (2239)..(2239): n is a, c, g, or t
  misc_feature (2242)..(2242): n is a, c, g, or t
  misc_feature (2244)..(2244): n is a, c, g, or t
  misc_feature (2249)..(2249): n is a, c, g, or t
  misc_feature (2307)..(2307): n is a, c, g, or t
  misc_feature (2312)..(2313): n is a, c, g, or t
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308624 - DNA, 3257 bp, Homo sapiens
  misc_feature (1267)..(1268): n is a, c, g, or t
  misc_feature (1274)..(1274): n is a, c, g, or t
  misc_feature (1428)..(1428): n is a, c, g, or t
  misc_feature (1441)..(1441): n is a, c, g, or t
  misc_feature (1444)..(1444): n is a, c, g, or t
  misc_feature (1446)..(1446): n is a, c, g, or t
  misc_feature (1451)..(1451): n is a, c, g, or t
  misc_feature (1509)..(1509): n is a, c, g, or t
  misc_feature (1514)..(1515): n is a, c, g, or t
ccacgcgtccgacccacgcgtcgctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308625 - DNA, 1516 bp, Homo sapiens
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatggcagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttct

SEQ ID NO: 308626 - DNA, 3092 bp, Homo sapiens
  misc_feature (1102)..(1103): n is a, c, g, or t
  misc_feature (1109)..(1109): n is a, c, g, or t
  misc_feature (1263)..(1263): n is a, c, g, or t
  misc_feature (1276)..(1276): n is a, c, g, or t
  misc_feature (1279)..(1279): n is a, c, g, or t
  misc_feature (1281)..(1281): n is a, c, g, or t
  misc_feature (1286)..(1286): n is a, c, g, or t
  misc_feature (1344)..(1344): n is a, c, g, or t
  misc_feature (1349)..(1350): n is a, c, g, or t
gcttcctattaggtgcatgagtaggtggcctgcagtaatgttagcggttaggcgtacggccagggctattggttgaatgagtaggttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaattagaaaatatagtttgaggccgggcacggtggctcacgcctgtaatcccagtacttgggaggccaaggcaggcatatcaacttgaggccaggagttaaagagcagcctggctaacatggtgaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308627 - DNA, 3054 bp, Homo sapiens
  misc_feature (1064)..(1065): n is a, c, g, or t
  misc_feature (1071)..(1071): n is a, c, g, or t
  misc_feature (1225)..(1225): n is a, c, g, or t
  misc_feature (1238)..(1238): n is a, c, g, or t
  misc_feature (1241)..(1241): n is a, c, g, or t
  misc_feature (1243)..(1243): n is a, c, g, or t
  misc_feature (1248)..(1248): n is a, c, g, or t
  misc_feature (1306)..(1306): n is a, c, g, or t
  misc_feature (1311)..(1312): n is a, c, g, or t
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacaccactgtactccagcctggatgacagagtggagactctgtttcaaaaaaacagaaaagaaaatatagtttgattcttcatttttttaaatttgcaaatctcaggataaagtttgctaagtaaattagtaatgtactatagatataactgtacaaaaattgttcaacctaaaacaatctgtaattgcttattgttttattgtatactctttgtctttttaagacccctaatagccttttgtaacttgatggcttaaaaatacttaataaatctgccatttcaaatttctatcattgccacataccattcttattcctaggcaactattaataatctatcctgagaatattaattgtggtattctggtgatggggtttagcaactttgatggaagaaaatattaggctataaatgtcctaaggactcagattgtatctttgtacagaagaggattcaaaacgccacgtgtagtggctcatgcctgtnntcccgncactttgggaggctgaggtgggaggatcgtcttgagcccaggagttcgagaccagcctggacaacgtggtgagaccttgtctccacaaaaataaaaaagaaactatccaggagtggtggtgtgtgcctgtggtccctgctatgcagatgtctangacaggaggatcncangngcccnggaggttgagaatgcagtgagcttgtaattgcaccactgcactccagcctgggtgacngagcnngaccctgtcttaaaaaaagaggattcaacacatatttttatattatgttaaagtaaagaaatgcataaaagacaagcactttggaagaattattttaatgatcaacaatttaatgtattagtccaaattatttttacgtagtcatcaacaatttgaccagggcctttatttggcaaataactgagccaaccagaataaaataaccaatactccactgctcatatttttatctaattcagatggatcttccttacaactgctctagattagtagatgcatctaagcaggcagcaggaactttaaattttttaagttcatgtctatgacatgaacaatgtgtgggataatgtcattaatatatcctaaattaacctaaacgtatttcactaactctggctccttctccataaagcacattttaaggaacaagaattgctaaatataaaaacataaataataccataatacatggctatcatcaaaagtgtatagaatattatagtttaaaagtatttagttgattacttttcagttttgttttgttttttgagacggagtctcgctctgttgcccaggctggagtgcagtggcaccatctcagttcactgcaacttctgcctcccgggttcaagcgattctcctgcctcagcctcccgagtggctggaattataggcgtgcaccaccacgcccagctgatttttgtatttttggtggggacagggttttgccacattggccaggctggtctcaaactcctgacctcaggtgatccacccaccccagcctcccaaggtgctgagattacaggcgtgagccactgagcccagcctacttttcagtttttaacataatttttgttttatccacaacttttcaagtattgaaagtagaataaaaacatgggttcttagtctttagctatctgttaaagcctatgaatgccttcttaaaatcatgtttttaaatgcataaaatatataggattacaaaggaatctaattatatcgaaatacagttattaaaatgttaaaagataagtttgttatatattaatatgcatgcttctttataaatgcattaaataagagttaatagctatcctaaatttgaaatagtgataagcataatgaaaatagatgcaaaaaactaatgtgatatgaaaatatctgggtttttcttttgatgatgaagtattgctaatattaccgtggtttatgaactatgttcagaattgaagaaaatcctaactttcagttagaggttagtgacggggttcaggacaccctacacaaaatacagcactttgacatattgaatattttaagctgaaggcatttgaggaaattgcagaagcaggaaggtgactctgaccttctgcctgctgttctccccagaagcagccataaaacctgggaaggattttctgaccttcccctgaagtagatcataagactgtcatgtaagaggtgctctcctggcacccagagaaaaggagcatccttacctccaaaagcacagggacacaaagaggaatctaaacaaacaggcctctcagtttcccccagtttattacatttagcttgttcacactttgccctatgacatttctacatcactggctgctcttcatcaaacctactataaaaaacattcaagttcaactgtttctttgggcctttatttccttatggagcccctcgtgtcgtgtaaaacttatattaaataaatgtgcatgcttttc

SEQ ID NO: 308628 - DNA, 939 bp, Homo sapiens
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgtctctcagtgcccagaacctggtggattgctcaactgaaaaatatggaaacaaaggctgcaatggtggcttcatgacaacggctttccagtacatcattgataacaagggcatcgactcagacgcttcctatccctacaaagccatgatcagtgtcaatatgactcagatagtctgaagaagctgtggccatggcccc

SEQ ID NO: 308629 - DNA, 969 bp, Homo sapiens
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaagggtgtgttactgaagtgaaatatcaagtgagtattaccatcccaagcctctgaaccctaggtagagctctttaaatgcttagtctagctacagaatttgccagtgaatcttacagtcccacgtgttactttctagttatttttgttattcttgtcttcccaactaaattataaattccttaagggcaaggatcacatattatattttatttatacagttggccctccatatccacagcttccacatctgcagattccaccaaccgtggatcaaaaatatccagaaaaaaatgaaaataaaaaataggccaggcactcacgcctataataccatta

SEQ ID NO: 308630 - DNA, 665 bp, Homo sapiens
gacaagggctcttcttgatggcttactgtatccactttgtccccaagaccatagggaaatgactagaggtgactgtactagctagattttaaatgaaaccgaaatgaaagttcacttcctcattttgagtacctcatgtgacaagttccaatttcttttcaagtcaattgaactgaaatctccttgttgctttgaaatcttagaagagagcccactaattcaaggactcttactgtgggagcaactgctggttctatcacaatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgatgagttccctgagagttcccagccagtggcagagaaatatcacatataagtcaaaccctaatcggatattgcctgattctgtggactggagagagaaaggtgtagcggtggtatcggatcctctagagca

SEQ ID NO: 308631 - DNA, 381 bp, Homo sapiens
cagaatgtgaatcatggtgtacttgtggttggctatggtgatcttaatgggaaagaatactggcttgtgaaaaacaggtaatatatttacactttatatttaattggaatcaggaatttgagggagtttcagcaaatactctcatgattttgatgatgatcattatgatcacgatattgacaatgatgaactttatagcttcttacaaagtgacattctaaattactcagtgcccccatcttttcacttaccattctgccttcatcactttgttttcctggtttatcttctgtactacttctgtgattattccttctcagcctctctcatgaacctattcctctcctctatttagcccaaaaatgttagttttccccaggg

SEQ ID NO: 308632 - DNA, 1423 bp, Homo sapiens
gaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaa

SEQ ID NO: 308633 - DNA, 1083 bp, Homo sapiens
gaggaagaagcggaggaggcggctcccgcgctcgcagggccgtgccacctgcccgcccgcccgctcgctcgctcgccccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaa

SEQ ID NO: 308634 - DNA, 1939 bp, Homo sapiens
gaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaaaaaaaaaaacaaaacaaaaaaaaaaaaaaaaaaaaaacaacaaaaagggggggcggcgggcggcactaataaaggatccccccgggcggggcgcccaagcgctgtttacgcgcgcgtacccccggtttttttggtgctcaaacacgggcgcccccattatggaggggcgcgcgctatattattacagccatgggccacgggcgccggcggttaacaaaccggtgcgcggcggacggggagaaaaacgtgtataccgtgggggctatcttgggggagagagggactcccctaacttgtcggggggggggagacattatgtggggcgaccaacctcttcctaacgaggaagatttaaacacgctcaagagggaggaattaaataaactttctaaggggtgtattagggggtgtaacaaccatacgcgcgaatatggacgttgcacgcttaaaaagttttgggctcgaccgcgcatagcgttctcgtgaaaatttttttcccccgggagcttctgtatg

SEQ ID NO: 308635 - DNA, 1648 bp, Homo sapiens
gaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaaggtccttgggatagaataacgggagaccgcatacataaaaacaacaggggcgccgaaaatcaccggggggcacagcaaggacaccgctgtggtaagggcctaaggggggataagacgacggggcggacacgagcagaacacaggacgagcacactggcgtataggaaccgcaaaagaaaaactagaaaccgacaagacgatgaaacataagccgagatcatggcc

SEQ ID NO: 308636 - DNA, 1390 bp, Homo sapiens
gaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaa

SEQ ID NO: 308637 - DNA, 1595 bp, Homo sapiens
gaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggacatctctctacccagctgctgatgccaacaactgtccttctgctttccacgggggaggaacggagtggcggacgcggaagcggggacaggatgggggcagggggacgagaaatttacaacatagaaccgtgaccttgccatcgatcaagaggcgagtaacaccaacaacacacaccacgggccacacaaatacacaggacagaacgcacgtcggaccggacctagagcaacaacagcagacaagcgcaatcacagaaaggaacccccgctgaggcaacacataaaagcagtcaacacaccacacccacaaacacaaaacaacaacacagaacacacacacaa

SEQ ID NO: 308638 - DNA, 1362 bp, Homo sapiens
gaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaagtcccttttgcataagattaaaggaaggaaaagtaaagtgtgtgt

SEQ ID NO: 308639 - DNA, 1435 bp, Homo sapiens
gaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaagtcccttttgcataagattaaaggaaggaaaagtaaagtgtgtgt

SEQ ID NO: 308640 - DNA, 946 bp, Homo sapiens
gaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacaggtgagcatggtgccagcctg

SEQ ID NO: 308641 - DNA, 891 bp, Homo sapiens
gactgtggcaggctggagctgttttcaaggcctccttcacctaggctgtgcatacaaaaggttgaagaaagtataaggagacttaatggacgcttgttggacagacatcacgaagcttcatgccctgcaacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggctcgcggggtgcacacccagcggatgcagtagaccgcagccagccggtgcctggcgcccctgccccccgcccctctccaaacaccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagtaaa

SEQ ID NO: 308642 - DNA, 627 bp, Homo sapiens
tctgcttttaataagcttcccaatcagctctcgagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagggaaccagaaaaaaaaggtgagagttctactttgggaatgcatggattttttttcccaccatggatcttggtcggcacagggggctatggctggactgatccaaccaccttggccca

SEQ ID NO: 308643 - DNA, 435 bp, Homo sapiens
tctgcttttaataagcttcccaatcagctctcgagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaagtatcataggactatggatgagcatcccatggcttgggcag

SEQ ID NO: 308644 - DNA, 1584 bp, Homo sapiens
tctgcttttaataagcttcccaatcagctctcgagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308645 - DNA, 1620 bp, Homo sapiens
ggctgcaggattcggcacgagtaaacaccagcttgttgttgagcagcagctggaagccctcccgcttgccttgctcatcacccctgtgcagctcgtcggcctgctgcaggaggggcagcacatcctccaagcctgaggaacctccagcctccagggcactggaggcacctgaagctgcctcttcctccaagtcaagagaatcctttctccccatcttcacagtctcacagctcacttcatcttccccgtcctcactttctttgtcagagtcccgctcattgtcagactccgcattggctgttgtgtaaccctcgtgccgaattcggcacgagggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308646 - DNA, 2146 bp, Homo sapiens
agcaacaatagaaacaaaagagaaagagaaagactagataaaagtaagaagagaacagaacgtgaaaatctcagaaagttagataccatgtttccaccattatatgaaagaacagaagaacagattttgtgaaattagaaaagctatgtgaacataaatatgaacaagagaaatgtattgaggtcaaatctcatacaaagtaacttaaaaggagagaatgaacagaaaaaggggaagaccattatttatatggccaattcaagaatttctgaatatgctcaagaaacagaacaacaaaaatctttgtaacctacagtttcaaaacgagttacaaaacactaagaaaacaatataaaatgtaaaagagcatcacaaattataattagaaaactcagcaatgaggtgacagaactaggaaagaattaaggggaaataagggacaagagagaccctctcatattgttttatattatttcatactcagaaaaggaaagagaagccaaacaaaaggcaggtaacccagcgcctaggaaccagacccgaaaccaaggaaccagatctgaaaccaggcctgggcctgcctgacctaagcctggtagtaaaaattccacccctgacctgacctggcaactgttgttatctacagattccagacattgtatggaaggacactgtgaaacctcccgttctgttctgtttcactctgaccatcggtgctcacagcccctatcacgtaccccctggcttgctcagtcgatcacgaccctctcacgtggacccccttagagttgttagcccttaaaagggacagaagttgagcacctgaggagctcagattttaagacgctaggctgctgatgctcccagctgattaaagccactcccttcactatctcggtgtctcctgtccgcggctcgtcctgctacatttcttggttccctgaccggcaagcgagaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308647 - DNA, 1562 bp, Homo sapiens
ggctgcaggattcggcacgagtaaacaccagcttgttgttgagcagcagctggaagccctcccgcttgccttgctcatcacccctgtgcagctcgtcggcctgctgcaggaggggcagcacatcctccaagcctgaggaacctccagcctccagggcactggaggcacctgaagctgcctcttcctccaagtcaagagaatcctttctccccatcttcacagtctcacagctcacttcatcttccccgtcctcactttctttgtcagagtcccgctcattgtcagactccgcattggctgttgtgtaaccctcgtgccgaattcggcacgagggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagcagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308648 - DNA, 1569 bp, Homo sapiens
tctgcttttaataagcttcccaatcagctctcgagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgcctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308649 - DNA, 910 bp, Homo sapiens
ttggatagtcaatgagaggaacatattacaggcttatttcctttaaatgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308650 - DNA, 1004 bp, Homo sapiens
  misc_feature (104)..(106): n is a, c, g, or t
agctctgtatatttgaactgctccttatgtgacaaaataggtagctcttgggctcatatactgggatgattatatctgtatatgtatttactccaggccagcannnagtcgtttgagaattgtagcctgttgttttcgctgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308651 - DNA, 1055 bp, Homo sapiens
ctaagtgaaaatgagcaacatcaggacagcatgacattaaagtatgtactatagagatctgatgagaaacagttcttaccctaaatattttgttatattgtcgccattatgaatttataaagacaggaaaatatagttgcctatgttttagggaccactattaaagcttataaatatttgtgtattttcatttagaagtaccatctacgagagtagtttatactgcactgtgtacatgaatggctaatgaatctattttccaactttcccgtgttttatagatatttcttttcactttgggctagcccaaagtgaaacagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308652 - DNA, 806 bp, Homo sapiens
  misc_feature (64)..(64): n is a, c, g, or t
  misc_feature (66)..(67): n is a, c, g, or t
gtgatagtgataaatgctgtaaaatatagaggagggaagagaatctagcgggaactagagcagntnngcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308653 - DNA, 810 bp, Homo sapiens
aataataacgttgcgacttctgcgacagacacagcgacgaggggcccttacgggaaacaaggagcagactagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308654 - DNA, 824 bp, Homo sapiens
acactgtttactacatcggtcacccatatccaacatcagacgcgacacagcggcctgactcggataacaagcagcagcaccttggccagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308655 - DNA, 822 bp, Homo sapiens
  misc_feature (18)..(18): n is a, c, g, or t
atcactatactccaacantcatcattggtcatcgaccgcgcaggaataacggcggttaccgagcatactaagcagcagcatttgcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308656 - DNA, 818 bp, Homo sapiens
tctatgtaggtatatgtagacaatcacggtcagaccaaccaacgaggcggcgcttgcacggaaaccaacaagagcactagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308657 - DNA, 812 bp, Homo sapiens
  misc_feature (42)..(43): n is a, c, g, or t
ataattgaaaaaataagaatcacacataaattaattgtccanncctcgttagaagcaactaatagtagcatttgcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308658 - DNA, 807 bp, Homo sapiens
ttatgtgcatcaaatacgccgatcctgcacgcaagcagcggcgcttgcgggatactaacagcagaattgcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308659 - DNA, 806 bp, Homo sapiens
  misc_feature (55)..(55): n is a, c, g, or t
tcgtttagagttttttcgcgcaggtgtacgaggcgcagacgcgcgcccctcacanggatactagcagacagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308660 - DNA, 804 bp, Homo sapiens
  misc_feature (8)..(8): n is a, c, g, or t
  misc_feature (53)..(53): n is a, c, g, or t
tcaattantctagtaagtctatatatcactaaggcgggcacggccactttacngggatgacaagagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308661 - DNA, 796 bp, Homo sapiens
aagaagatacaatgtaaatataaataacacagcaccccgggcctacatggataacaaccagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308662 - DNA, 794 bp, Homo sapiens
gagtggcaatagagaagtaccgccataccccaaaggcgggggcttgccggatacaacagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308663 - DNA, 793 bp, Homo sapiens
atctaataatgtagctcatctctttatcaaacaacttaattcccttagaagtaaccagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308664 - DNA, 855 bp, Homo sapiens
tgcctccctttcctcctctaagatcctgcttgaggtttgggcttggtcagtttgccacagggcttggagatggtgacagtcttctggcattcggcattgtgcagggctcaaacctcacagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaa

SEQ ID NO: 308665 - DNA, 880 bp, Homo sapiens
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagt

SEQ ID NO: 308666 - DNA, 1082 bp, Homo sapiens
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgtgaattcagatttccaatcttctcctagccaaccattttcctggaattaaaaattcagtaaaaaaggaaactatagattatgtggt

SEQ ID NO: 308667 - DNA, 950 bp, Homo sapiens
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactccta

SEQ ID NO: 308668 - DNA, 830 bp, Homo sapiens
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagt

SEQ ID NO: 308669 - DNA, 676 bp, Homo sapiens
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaaggctgacattcatctggtggaacttctctactacgtcgaggagcttgactccagtcttatctccagcttccctctgctgaaggtgacccatttcacagcccagagaggcagccccacatctcccatct

SEQ ID NO: 308670 - DNA, 716 bp, Homo sapiens
  misc_feature (654)..(655): n is a, c, g, or t
  misc_feature (716)..(716): n is a, c, g, or t
cacgagcagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaaggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggacnnggttatacgagcatgaggcagacttgatacatgtctaagttcgacataagactactaggtn

SEQ ID NO: 308671 - DNA, 1199 bp, Homo sapiens
  misc_feature (986)..(986): n is a, c, g, or t
  misc_feature (991)..(991): n is a, c, g, or t
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaanaaaanaaaaaaaaataaaaaaaaataaaaaaaaaatttgagagggggcccatgcccaatacccccttatgggagcgttttcacatttaagtgcccggtgttcaccacgcaggcattgggaaaaccctggggtatccaaattaaagcgtttgaagaaattccccttttgccaagtggggaaaaacgaaaaaggcccccccagagggcctttcaa

SEQ ID NO: 308672 - DNA, 1032 bp, Homo sapiens
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaaggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgtgaattcagatttccaatcttctcctagccaaccattttcctggaattaaaaattcagtaaaaaaggaaactatagattatgtggt

SEQ ID NO: 308673 - DNA, 824 bp, Homo sapiens
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacaagattttcaggttttaataacgcagtcatggaggccaagaacttgcaataccaatgttctaaagttttgcaacaataaagtactttacctaagt

SEQ ID NO: 308674 - DNA, 1140 bp, Homo sapiens
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaagctctccagaacactggccccccacactgtatctctcactgagaaaaggtggtcccatggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgtgaattcagatttccaatcttctcctagccaaccattttcctggaattaaaaattcagtaaaaaaggaaactatagattatgtggt

SEQ ID NO: 308675 - DNA, 1030 bp, Homo sapiens
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgtgaattcagatttccaatcttctcctagccaaccattttcctggaattaaaaattcagtaaaaaaggaaactatagattatgtggt

SEQ ID NO: 308676 - DNA, 949 bp, Homo sapiens
cttctttcagtgggagagaactattgagaggaacaaagagcttataaatacattaggacctggaattcagttgtcgagccaggacggtgacagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatggattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgtgaattcagatttccaatcttctcctagccaaccattttcctggaattaaaaattcagtaaaaaaggaaactatagattatgtggt

SEQ ID NO: 308677 - DNA, 948 bp, Homo sapiens
cacgagcagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaaggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgtgaattcagatttccaatcttctcctagccaaccattttcctggaattaaaaattcagtaaaaaaggaaactatagattatgtggt

SEQ ID NO: 308678 - DNA, 821 bp, Homo sapiens
cacgagcagcgtttaacaaagcttagagaaacctccaggagactgctatcatggcagagaagcccaagctccactacttcaatgcacggggcagaatggagtccacccggtggctcctggctgcagctggagtagagtttgaagagaaatttataaaatctgcagaagatttggacaagttaagaaatggattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttagaagaagcaaggagcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgtgaattcagatttccaatcttctcctagccaaccattttcctggaattaaaaattcagtaaaaaaggaaactatagattatgtggt

SEQ ID NO: 308679 - DNA, 432 bp, Homo sapiens
agatagagatgactgaactgattaaaacttcaagacatctttggggaaaataaagtgagctacatgtccttccccttatcttcatttctcactgggtgtctgtttctgcctccatgcttgtgctgatggagcagactcacttggtctttgcaggaggggctcagattccctgggtcatgttaatggtggtgtcagcccttggcttcactctgaggctgtgctttatgaattacaggccctgaaaaccagaatcagcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttaccta

SEQ ID NO: 308680 - DNA, 249 bp, Homo sapiens
caagaacgtatttactgtttctgcttccagtttgaagagaaatttataaaatctgcagaagatttggacaagttaagaaatggtaagatcaatctctaagttcctctgatgagggtatctagtagaaggtacacggggaggtttgcgcagccggcaatgtctatgggtgtggggcatggtatttgtacatggtgcagagggagaaagtggttaaaatggaagggatgtggctccttgagcaagtctggc

SEQ ID NO: 308681 - DNA, 597 bp, Homo sapiens
gtgcctcagcctcccgattagctagaattacaggctcccaccaccacacccggctaatttttgtatttttagtagagacagggtttcaccatgttggccaggctggtctcaaaactcctgacctcagctgatccacccgccttagcctcccaaagtgctgggattacaggcatgagctgccgcgcccggcctgcttcattattttcctgaagagttgcatcagctcacactcctcccagcagcatatggatgggcccttgcccttgcatcctcttcgctcagctcattttctctttgttttattgtcttgtggttaggctgtagactggaccttaagcagtggaattcttgtctcctgttcaggtgaagtgatctgtgaacctcccaacaacaaactggacaaattcagctgccattttcttcttagccacctcctcacaccattttaaatggacaggtgtgtgtaggggcccgtcctgggccagccagctgctcggcctgcaactttggactagaaatcgacactctgccccatgccgcagttttctcctctatattttttctgaaatttttttttgtagagactgcctcgccaag

SEQ ID NO: 308682 - DNA, 5300 bp, Homo sapiens
tccagcgagaccaacatgaaagtacgtcaggcgattccagtcacctcagaattgggagacatcagtaagcttgccaagtttgacggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatggtgatgtgtttgacgtcctgggacacaaagctgaattgggagagaggcctgaacctgttgacttctccttcaatcctctggctgacaagaagttcttattttgggaccccagcctgctggaggctgtcaagatcggggacccccacacgcatgagttcttccgcctcctttccctgtgtcatactgtcatgtcagaagaaaagaacgaaggagagctgtactacaaagctcagtccccagatgagggggccctggtcaccgcagccaggaactttggttttgttttccgctctcgcacccccaaaacaatcaccgtccatgagatgggcacagccatcacctaccagctgctggccatcctggacttcaacaacatccgcaagcggatgtcggtcatagtgcggaatccagaggggaagatccgactctactgcaaaggggctgacactatcctactggacagactgcaccactccactcaagagctgctcaacaccaccatggaccaccttaatgagtacgcaggggaagggctgaggaccctggtgctggcctacaaggatctggatgaagagtactacgaggagtgggctgagcgacgcctccaggccagcctggcccaggacagccgggaggacaggctggctagcatctatgaggaggttgagaacaacatgatgctgctgggtgcaacggccattgaggacaaacttcagcaaggggttccagagaccattgccctcctgacactggccaacatcaagatttgggtgctaaccggagacaagcaagagacggctgtgaacatcggctattcctgcaagatgctgacggatgacatgactgaggttttcatagtcactggccatactgtcctggaggtgcgggaggagctcaggaaagcccgggagaagatgatggactcatcccgctccgtaggcaacggcttcacctatcaggacaagctttcttcttccaagctaacttctgtcctggaggccgttgctggggagtacgccctggtcataaatggtcacagcctggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaacggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggcttcttctgtggcttctcagcccagaccgtctatgaccagtatttcatcaccctgtataacatcgtgtacacctccctgccagtcctggctatgggggtctttgatcaggatgtccccgagcagcggagcatggagtaccctaagctgtatgagccgggccagctgaaccttctcttcaacaagcgggagttcttcatctgcatcgcccagggcatctacacctccgtgctcatgttcttcattccctatggggtgtttgctgatgccacccgggatgatggcactcagctggctgactaccagtcctttgcagtcactgtggccacatccttggtcattgtggttagcgtgcagattgggctcgacacaggctactggacggccatcaaccacttcttcatctggggaagccttgctgtttactttgccatcctctttgccatgcacagcaatgggctcttcgacatgtttcccaaccagttccggtttgtggggaatgcccagaacaccttggcccagcccacggtgtggctgaccattgtgctcaccacagtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccagtggcggtgccgacaagcccctcaagggctgaaggccgaggatggatgccctgtgccagtgaccagagcacccagggctggccagtcactgagggaacagcgtctcggaactgctggtcctcattccttgcttcccgtccccccggtagactctgtcctgctggtcccaccacacatggctgggacatctgttcccagctgtaggcccttccaccagctggggagctagagggagcaggcccaagggcagagcagaggctgaggcacggggagccagccccactcggggaccagaagtggaaccaaaaacaagaaaaaactgtgagagattgtgtctgcccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttttttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggtagttttcttttcttttttctttttctttttttctttttttttttgagatggagtctcactcttgtcacctaggcaagagtgcaatggcacaatctcagctcactgcaacctccacctcctgggttcaagcgattctcctgcctcagcctcctgagtagctgggattacaggcacacaccaccacgcttggttaatttttgtatttttagtagagatgtttcaccatgttggccaggctagtcttgaattcctgacctcctgacctgcccacctcaacctcccaaagtgctgagattacaggcgtgagccaccacacccagctcagggaggcgtagttttctttaattttaaatttaaacccaagtttattggcagactcccttttgacctccctttgcctccccatctggtgctttcttgcatctacaccccagggccctgtggtggggctgcagggggaagctgtgcacctgagatgaggctggaacgggaattggcctctctgctcccttcttcagtaagcaaggagccccgcccctcaggcccagcctctggcaagaggtggtggaatccttgtgccgggtagtagaggaggataagggcaaaaccaggcccaggccagtgcctggcttggtctggatgggacactgtcagagtttggccacagcctgtcctttacttcatccacacctatgaagctattccctaaataaggcatttcccaagttagtcgctacctaatcagccttgagaagaatcctttcctcttctttgatagtgggtcgggggattcttcaggaatggtttggagctgggagtgggtagggggattttaaatgttccatatgggagccccaaaggaactggatgggctgcagtgaggtgggggcgggtgggcagggaatgggagaggggaagtcttggcagggaaatcccttttggccacacagtttacaaacccagtatcatgtctgtctgtgtgtctctcaaggtgagagtctgatttttataccaaagaggaaatgattttttttcatattttgtttgtctatattatataaatatatatatacagtatatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctgagaaaaagtaatttgtctcttttctgatgtttaaccaagactggt

SEQ ID NO: 308683 - DNA, 5578 bp, Homo sapiens
gtgcctcagcctcccgattagctagaattacaggctcccaccaccacacccggctaatttttgtatttttagtagagacagggtttcaccatgttggccaggctggtctcaaaactcctgacctcagctgatccacccgccttagcctcccaaagtgctgggattacaggcatgagctgccgcgcccggcctgcttcattattttcctgaagagttgcatcagctcacactcctcccagcagcatatggatgggcccttgcccttgcatcctcttcgctcagctcattttctctttgttttattgtcttgtggttaggctgtagactggaccttaagcagtggaattcttgtctcctgttcaggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatggtgatgtgtttgacgtcctgggacacaaagctgaattgggagagaggcctgaacctgttgacttctccttcaatcctctggctgacaagaagttcttattttgggaccccagcctgctggaggctgtcaagatcggggacccccacacgcatgagttcttccgcctcctttccctgtgtcatactgtcatgtcagaagaaaagaacgaaggagagctgtactacaaagctcagtccccagatgagggggccctggtcaccgcagccaggaactttggttttgttttccgctctcgcacccccaaaacaatcaccgtccatgagatgggcacagccatcacctaccagctgctggccatcctggacttcaacaacatccgcaagcggatgtcggtcatagtgcggaatccagaggggaagatccgactctactgcaaaggggctgacactatcctactggacagactgcaccactccactcaagagctgctcaacaccaccatggaccaccttaatgagtacgcaggggaagggctgaggaccctggtgctggcctacaaggatctggatgaagagtactacgaggagtgggctgagcgacgcctccaggccagcctggcccaggacagccgggaggacaggctggctagcatctatgaggaggttgagaacaacatgatgctgctgggtgcaacggccattgaggacaaacttcagcaaggggttccagagaccattgccctcctgacactggccaacatcaagatttgggtgctaaccggagacaagcaagagacggctgtgaacatcggctattcctgcaagatgctgacggatgacatgactgaggttttcatagtcactggccatactgtcctggaggtgcgggaggagctcaggaaagcccgggagaagatgatggactcatcccgctccgtaggcaacggcttcacctatcaggacaagctttcttcttccaagctaacttctgtcctggaggccgttgctggggagtacgccctggtcataaatggtcacagcctggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaacggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggcttcttctgtggcttctcagcccagaccgtctatgaccagtatttcatcaccctgtataacatcgtgtacacctccctgccagtcctggctatgggggtctttgatcaggatgtccccgagcagcggagcatggagtaccctaagctgtatgagccgggccagctgaaccttctcttcaacaagcgggagttcttcatctgcatcgcccagggcatctacacctccgtgctcatgttcttcattccctatggggtgtttgctgatgccacccgggatgatggcactcagctggctgactaccagtcctttgcagtcactgtggccacatccttggtcattgtggttagcgtgcagattgggctcgacacaggctactggacggccatcaaccacttcttcatctggggaagccttgctgtttactttgccatcctctttgccatgcacagcaatgggctcttcgacatgtttcccaaccagttccggtttgtggggaatgcccagaacaccttggcccagcccacggtgtggctgaccattgtgctcaccacagtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccagtggcggtgccgacaagcccctcaagggctgaaggccgaggatggatgccctgtgccagtgaccagagcacccagggctggccagtcactgagggaacagcgtctcggaactgctggtcctcattccttgcttcccgtccccccggtagactctgtcctgctggtcccaccacacatggctgggacatctgttcccagctgtaggcccttccaccagctggggagctagagggagcaggcccaagggcagagcagaggctgaggcacggggagccagccccactcggggaccagaagtggaaccaaaaacaagaaaaaactgtgagagattgtgtctgcccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttttttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggtagttttcttttcttttttctttttctttttttctttttttttttgagatggagtctcactcttgtcacctaggcaagagtgcaatggcacaatctcagctcactgcaacctccacctcctgggttcaagcgattctcctgcctcagcctcctgagtagctgggattacaggcacacaccaccacgcttggttaatttttgtatttttagtagagatgtttcaccatgttggccaggctagtcttgaattcctgacctcctgacctgcccacctcaacctcccaaagtgctgagattacaggcgtgagccaccacacccagctcagggaggcgtagttttctttaattttaaatttaaacccaagtttattggcagactcccttttgacctccctttgcctccccatctggtgctttcttgcatctacaccccagggccctgtggtggggctgcagggggaagctgtgcacctgagatgaggctggaacgggaattggcctctctgctcccttcttcagtaagcaaggagccccgcccctcaggcccagcctctggcaagaggtggtggaatccttgtgccgggtagtagaggaggataagggcaaaaccaggcccaggccagtgcctggcttggtctggatgggacactgtcagagtttggccacagcctgtcctttacttcatccacacctatgaagctattccctaaataaggcatttcccaagttagtcgctacctaatcagccttgagaagaatcctttcctcttctttgatagtgggtcgggggattcttcaggaatggtttggagctgggagtgggtagggggattttaaatgttccatatgggagccccaaaggaactggatgggctgcagtgaggtgggggcgggtgggcagggaatgggagaggggaagtcttggcagggaaatcccttttggccacacagtttacaaacccagtatcatgtctgtctgtgtgtctctcaaggtgagagtctgatttttataccaaagaggaaatgattttttttcatattttgtttgtctatattatataaatatatatatacagtatatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctgagaaaaagtaatttgtctcttttctgatgtttaaccaagactggt

SEQ ID NO: 308684 - DNA, 5387 bp, Homo sapiens
  misc_feature (13)..(13): n is a, c, g, or t
tttttttttaaanttgggaaacaaacttatcttcataaacgtagatttcttttttgaaacagggtcttgctttgttgcccaggctggtctcaaactcctgacctcaggtgatccatccgcctcaacctcccaaaatgctgggattacaggcttgagccactgcgcccagcccataatagtttttttttttttttaattatttttcatttaacattcagctgttaccaaaatctcatagtgttttaagaaagtttatgaatctgtgttgggccacatgtggcccagagaccatgggttggacaagcttgcactagagcatctgagcttttgagggctcaagggatgaatacatcacagatgcacttggttttgagggcttcctacatgtcagcctcgcctgtgcttctcattcctccccagatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatggtgatgtgtttgacgtcctgggacacaaagctgaattgggagagaggcctgaacctgttgacttctccttcaatcctctggctgacaagaagttcttattttgggaccccagcctgctggaggctgtcaagatcggggacccccacacgcatgagttcttccgcctcctttccctgtgtcatactgtcatgtcagaagaaaagaacgaaggagagctgtactacaaagctcagtccccagatgagggggccctggtcaccgcagccaggaactttggttttgttttccgctctcgcacccccaaaacaatcaccgtccatgagatgggcacagccatcacctaccagctgctggccatcctggacttcaacaacatccgcaagcggatgtcggtcatagtgcggaatccagaggggaagatccgactctactgcaaaggggctgacactatcctactggacagactgcaccactccactcaagagctgctcaacaccaccatggaccaccttaatgagtacgcaggggaagggctgaggaccctggtgctggcctacaaggatctggatgaagagtactacgaggagtgggctgagcgacgcctccaggccagcctggcccaggacagccgggaggacaggctggctagcatctatgaggaggttgagaacaacatgatgctgctgggtgcaacggccattgaggacaaacttcagcaaggggttccagagaccattgccctcctgacactggccaacatcaagatttgggtgctaaccggagacaagcaagagacggctgtgaacatcggctattcctgcaagatgctgacggatgacatgactgaggttttcatagtcactggccatactgtcctggaggtgcgggaggagctcaggaaagcccgggagaagatgatggactcatcccgctccgtaggcaacggcttcacctatcaggacaagctttcttcttccaagctaacttctgtcctggaggccgttgctggggagtacgccctggtcataaatggtcacagcctggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaacggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggcttcttctgtggcttctcagcccagaccgtctatgaccagtatttcatcaccctgtataacatcgtgtacacctccctgccagtcctggctatgggggtctttgatcaggatgtccccgagcagcggagcatggagtaccctaagctgtatgagccgggccagctgaaccttctcttcaacaagcgggagttcttcatctgcatcgcccagggcatctacacctccgtgctcatgttcttcattccctatggggtgtttgctgatgccacccgggatgatggcactcagctggctgactaccagtcctttgcagtcactgtggccacatccttggtcattgtggttagcgtgcagattgggctcgacacaggctactggacggccatcaaccacttcttcatctggggaagccttgctgtttactttgccatcctctttgccatgcacagcaatgggctcttcgacatgtttcccaaccagttccggtttgtggggaatgcccagaacaccttggcccagcccacggtgtggctgaccattgtgctcaccacagtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccagtggcggtgccgacaagcccctcaagggctgaaggccgaggatggatgccctgtgccagtgaccagagcacccagggctggccagtcactgagggaacagcgtctcggaactgctggtcctcattccttgcttcccgtccccccggtagactctgtcctgctggtcccaccacacatggctgggacatctgttcccagctgtaggcccttccaccagctggggagctagagggagcaggcccaagggcagagcagaggctgaggcacggggagccagccccactcggggaccagaagtggaaccaaaaacaagaaaaaactgtgagagattgtgtctgcccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttttttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggtagttttcttttcttttttctttttctttttttctttttttttttgagatggagtctcactcttgtcacctaggcaagagtgcaatggcacaatctcagctcactgcaacctccacctcctgggttcaagcgattctcctgcctcagcctcctgagtagctgggattacaggcacacaccaccacgcttggttaatttttgtatttttagtagagatgtttcaccatgttggccaggctagtcttgaattcctgacctcctgacctgcccacctcaacctcccaaagtgctgagattacaggcgtgagccaccacacccagctcagggaggcgtagttttctttaattttaaatttaaacccaagtttattggcagactcccttttgacctccctttgcctccccatctggtgctttcttgcatctacaccccagggccctgtggtggggctgcagggggaagctgtgcacctgagatgaggctggaacgggaattggcctctctgctcccttcttcagtaagcaaggagccccgcccctcaggcccagcctctggcaagaggtggtggaatccttgtgccgggtagtagaggaggataagggcaaaaccaggcccaggccagtgcctggcttggtctggatgggacactgtcagagtttggccacagcctgtcctttacttcatccacacctatgaagctattccctaaataaggcatttcccaagttagtcgctacctaatcagccttgagaagaatcctttcctcttctttgatagtgggtcgggggattcttcaggaatggtttggagctgggagtgggtagggggattttaaatgttccatatgggagccccaaaggaactggatgggctgcagtgaggtgggggcgggtgggcagggaatgggagaggggaagtcttggcagggaaatcccttttggccacacagtttacaaacccagtatcatgtctgtctgtgtgtctctcaaggtgagagtctgatttttataccaaagaggaaatgattttttttcatattttgtttgtctatattatataaatatatatatacagtatatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctgagaaaaagtaatttgtctcttttctgatgtttaaccaagactggt

SEQ ID NO: 308685 - DNA, 4867 bp, Homo sapiens
gtctctccccaggcggagggcctgcagcgaaggcccatgtgggtggggcacctcctcttcttcccgacccaagcctcacctcttgtcccctgtgcagtgtggaggtcatccgtctgggccacagctacttcatcaactgggataagaagatgttctgcatgaagaagcggacgcctgcagaagcccgcaccaccaccctaaacgaggagctgggccaggtggagtacatcttctccgacaagacgggcaccctcacccagaacatcatggttttcaacaagtgctccatcaatggccacagctatggtgatgtgtttgacgtcctgggacacaaagctgaattgggagagaggcctgaacctgttgacttctccttcaatcctctggctgacaagaagttcttattttgggaccccagcctgctggaggctgtcaagatcggggacccccacacgcatgagttcttccgcctcctttccctgtgtcatactgtcatgtcagaagaaaagaacgaaggagagctgtactacaaagctcagtccccagatgagggggccctggtcaccgcagccaggaactttggttttgttttccgctctcgcacccccaaaacaatcaccgtccatgagatgggcacagccatcacctaccagctgctggccatcctggacttcaacaacatccgcaagcggatgtcggtcatagtgcggaatccagaggggaagatccgactctactgcaaaggggctgacactatcctactggacagactgcaccactccactcaagagctgctcaacaccaccatggaccaccttaatgagtacgcaggggaagggctgaggaccctggtgctggcctacaaggatctggatgaagagtactacgaggagtgggctgagcgacgcctccaggccagcctggcccaggacagccgggaggacaggctggctagcatctatgaggaggttgagaacaacatgatgctgctgggtgcaacggccattgaggacaaacttcagcaaggggttccagagaccattgccctcctgacactggccaacatcaagatttgggtgctaaccggagacaagcaagagacggctgtgaacatcggctattcctgcaagatgctgacggatgacatgactgaggttttcatagtcactggccatactgtcctggaggtgcgggaggagctcaggaaagcccgggagaagatgatggactcatcccgctccgtaggcaacggcttcacctatcaggacaagctttcttcttccaagctaacttctgtcctggaggccgttgctggggagtacgccctggtcataaatggtcacagcctggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaacggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggcttcttctgtggcttctcagcccagaccgtctatgaccagtatttcatcaccctgtataacatcgtgtacacctccctgccagtcctggctatgggggtctttgatcaggatgtccccgagcagcggagcatggagtaccctaagctgtatgagccgggccagctgaaccttctcttcaacaagcgggagttcttcatctgcatcgcccagggcatctacacctccgtgctcatgttcttcattccctatggggtgtttgctgatgccacccgggatgatggcactcagctggctgactaccagtcctttgcagtcactgtggccacatccttggtcattgtggttagcgtgcagattgggctcgacacaggctactggacggccatcaaccacttcttcatctggggaagccttgctgtttactttgccatcctctttgccatgcacagcaatgggctcttcgacatgtttcccaaccagttccggtttgtggggaatgcccagaacaccttggcccagcccacggtgtggctgaccattgtgctcaccacagtcgtctgcatcatgcccgtggttgccttccgattcctcaggctcaacctgaagccggatctctccgacacggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgacagtgccagtagccccagtggcggtgccgacaagcccctcaagggctgaaggccgaggatggatgccctgtgccagtgaccagagcacccagggctggccagtcactgagggaacagcgtctcggaactgctggtcctcattccttgcttcccgtccccccggtagactctgtcctgctggtcccaccacacatggctgggacatctgttcccagctgtaggcccttccaccagctggggagctagagggagcaggcccaagggcagagcagaggctgaggcacggggagccagccccactcggggaccagaagtggaaccaaaaacaagaaaaaactgtgagagattgtgtctgcccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttttttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggtagttttcttttcttttttctttttctttttttctttttttttttgagatggagtctcactcttgtcacctaggcaagagtgcaatggcacaatctcagctcactgcaacctccacctcctgggttcaagcgattctcctgcctcagcctcctgagtagctgggattacaggcacacaccaccacgcttggttaatttttgtatttttagtagagatgtttcaccatgttggccaggctagtcttgaattcctgacctcctgacctgcccacctcaacctcccaaagtgctgagattacaggcgtgagccaccacacccagctcagggaggcgtagttttctttaattttaaatttaaacccaagtttattggcagactcccttttgacctccctttgcctccccatctggtgctttcttgcatctacaccccagggccctgtggtggggctgcagggggaagctgtgcacctgagatgaggctggaacgggaattggcctctctgctcccttcttcagtaagcaaggagccccgcccctcaggcccagcctctggcaagaggtggtggaatccttgtgccgggtagtagaggaggataagggcaaaaccaggcccaggccagtgcctggcttggtctggatgggacactgtcagagtttggccacagcctgtcctttacttcatccacacctatgaagctattccctaaataaggcatttcccaagttagtcgctacctaatcagccttgagaagaatcctttcctcttctttgatagtgggtcgggggattcttcaggaatggtttggagctgggagtgggtagggggattttaaatgttccatatgggagccccaaaggaactggatgggctgcagtgaggtgggggcgggtgggcagggaatgggagaggggaagtcttggcagggaaatcccttttggccacacagtttacaaacccagtatcatgtctgtctgtgtgtctctcaaggtgagagtctgatttttataccaaagaggaaatgattttttttcatattttgtttgtctatattatataaatatatatatacagtatatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctgagaaaaagtaatttgtctcttttctgatgtttaaccaagactggt

SEQ ID NO: 308686 - DNA, 947 bp, Homo sapiens
  misc_feature (13)..(13): n is a, c, g, or t
tttttttttaaanttgggaaacaaacttatcttcataaacgtagatttcttttttgaaacagggtcttgctttgttgcccaggctggtctcaaactcctgacctcaggtgatccatccgcctcaacctcccaaaatgctgggattacaggcttgagccactgcgcccagcccataatagtttttttttttttttaattatttttcatttaacattcagctgttaccaaaatctcatagtgttttaagaaagtttatgaatctgtgttgggccacatgtggcccagagaccatgggttggacaagcttgcactagagcatctgagcttttgagggctcaagggatgaatacatcacagatgcacttggttttgagggcttcctacatgtcagcctcgcctgtgcttctcattcctccccagatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcaggtatgtgccttctctgacctggggtctctccagggagtcaggcggtcccatagaacttttcttttctatgaagatgaagtccttgagaagtaacgagaagtcctcttcttcctgtactgtaaacatttgatgttatctgtttatctttgtgggcagagcaaactttttaccacagtttcctggtacttgggactgtattagagaaaaaaaaatattgatttattcagcacctatttattacatgcctactgtgtacaaagaagtgtgctaggtgccatcacaaataaaagatgaattaggaatggatctccttccttctaggagcttacg

SEQ ID NO: 308687 - DNA, 1138 bp, Homo sapiens
gtgcctcagcctcccgattagctagaattacaggctcccaccaccacacccggctaatttttgtatttttagtagagacagggtttcaccatgttggccaggctggtctcaaaactcctgacctcagctgatccacccgccttagcctcccaaagtgctgggattacaggcatgagctgccgcgcccggcctgcttcattattttcctgaagagttgcatcagctcacactcctcccagcagcatatggatgggcccttgcccttgcatcctcttcgctcagctcattttctctttgttttattgtcttgtggttaggctgtagactggaccttaagcagtggaattcttgtctcctgttcaggtgaagtgatctgtgaacctcccaacaacaaactggacaaattcagcggaaccctctactggaaggaaaataagttccctctgagcaaccagaacatgctgctgcggggctgtgtgctgcgaaacaccgagtggtgcttcgggctggtcatctttgcaggtcccgacactaagctgatgcaaaacagcggcagaacaaagttcaaaagaacgagtatcgatcgcctaatgaataccctggtgctctggatttttggattcctggtttgcatgggggtgatcctggccattggcaatgccatctgggagcacgaggtggggatgcgtttccaggtctacctgccgtgggatgaggcagtggacagtgccttcttctctggcttcctctccttctggtcctacatcatcatcctcaacaccgttgtgcccatttcactctatgtcaggtatgtgccttctctgacctggggtctctccagggagtcaggcggtcccatagaacttttcttttctatgaagatgaagtccttgagaagtaacgagaagtcctcttcttcctgtactgtaaacatttgatgttatctgtttatctttgtgggcagagcaaactttttaccacagtttcctggtacttgggactgtattagagaaaaaaaaatattgatttattcagcacctatttattacatgcctactgtgtacaaagaagtgtgctaggtgccatcacaaataaaagatgaattaggaatggatctccttccttctaggagcttacg

SEQ ID NO: 308688 - DNA, 3255 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaaggg

SEQ ID NO: 308689 - DNA, 848 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccaggtaatttttttaaaaaatgtagccgtgtgtcatatctaaataatctaaataactattcctttcttagagtgtgttacctgctaccatccatatatggaaaatttgctactggctccttaaaatgaagagatattgttattcagtcaaaaatgttaaaaattgttagcaaactaaactgaatcctgcccagcattagcaattctagtctttcttagtttcttaaacccacaatggtaaattcttcaaaacctttccatcaca

SEQ ID NO: 308690 - DNA, 799 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccagggtgagtgtcccgcgctggccgctggctccgtagaagccgaactggagggccaggctgggctcggcgcctcgcctggggcaattcgcccacttgcctttcgccaacctcagaaccttcctttctggcctccgcctttccagttcagcctgcgcagcccgcgggggtcctgacaggtctctgactctgatgccttctgcagccctagcatggcccccgcgggaacttgtgggcacctcgcgggccggattgcacctctgaagcctaccgctttgtaccaaacaaaatgttacgtgcgcatcgcggtgtcccgcggttactcacctccgcggttggaaattgcggactccgcaaagttccagggtctttggagctttccagcgcaccttcatttagcacttggttgagattttcttggccttctttttcttactctcccaacttattttcttaaattttctaaaaggaaggaggggtgctactcactacggatcttttggaagaagtacaaagtatccgacaatcattgaatgaacccag

SEQ ID NO: 308691 - DNA, 692 bp, Homo sapiens
  misc_feature (662)..(662): n is a, c, g, or t
  misc_feature (684)..(684): n is a, c, g, or t
  misc_feature (691)..(691): n is a, c, g, or t
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccagggtgagtgtcccgcgctggccgctggctccgtagaagccgaactggagggccaggctgggctcggcgcctcgcctggggcaattcgcccacttgcctttcgccaacctcagaaccttcctttctggcctccgcctttccagttcagcctgcgcagcccgcgggggtcctgacaggtctctgactctgatgccttctgcagccctagcatggcccccgcgggaacttgtgggcacctcgcgggccggattgcacctctgaagcctaccgctttgtaccaaacaaaatgttacgtgcgcatcgcggtgtcccgcggttactcacctccgcggttggaaattgcggactccgcaaagttccagggtctttggagctttccagcgcaaacccccctttttttttnccccaaaatttttttttttttnaaaaaang

SEQ ID NO: 308692 - DNA, 3320 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggaaaaaaaaattatttaaaaaattattaaaatataatattattttaaaaataaaaaaaaacctcaa

SEQ ID NO: 308693 - DNA, 3279 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggtttgtaatggtgaaaaaaaaaaca

SEQ ID NO: 308694 - DNA, 2912 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggaaaaaaaaattatttaaaaaattattaaaatataatattattttaaaaataaaaaaaaacctcaa

SEQ ID NO: 308695 - DNA, 2189 bp, Homo sapiens
ctccagaggatcccctgtgcggaccatcctcaaccaatttaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggaaaaaaaaattatttaaaaaattattaaaatataatattattttaaaaataaaaaaaaacctcaa

SEQ ID NO: 308696 - DNA, 2757 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaaatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggaaaaaaaaattatttaaaaaattattaaaatataatattattttaaaaataaaaaaaaacctcaa

SEQ ID NO: 308697 - DNA, 2019 bp, Homo sapiens
tgctatggatatagctaaaagaaatggactcttcattatgtcatttttttgtattggtgtctctaatctaaatgtgctcagaaacttcacatatgtaatgacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggaaaaaaaaattatttaaaaaattattaaaatataatattattttaaaaataaaaaaaaacctcaa

SEQ ID NO: 308698 - DNA, 2409 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaagtaagatgtattcataaaaataacataatgataatggcagctatttttttgagtacttactctacagcagacactaagtgcatccatcacatgcatgctttaacccactcataactccacagtgtgtaggtatttataagcaagaaaatgactgggttagataagttgaataatttacccaaggaaatagggaaattgtgatttgaaccagattctttacttttaaacactattttatgcagcctgcttagtttctaaaatagtcaaagggggtttttttgtttgttaataaataagcattttgaaagttcctagagaaagatgaaaaggaaactttagactgtggtcaaaagttagaaaaaatagaatgtatatcttgcttttagcccatttgaaattattttctgtttttgtttgtttctattcagttggatgttattgtaatttattgattatgttactgaaatattacctgatcctgatcaggttgtcttttaaaatgtctcagtgttctcaaattgccatttattgacatttgaattctgtttgcaatgaataaaaacttgtaaatgatctttaatgtaaaaaattt

SEQ ID NO: 308699 - DNA, 2269 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaattcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggaaaaaaaaattatttaaaaaattattaaaatataatattattttaaaaataaaaaaaaacctcaa

SEQ ID NO: 308700 - DNA, 1744 bp, Homo sapiens
aaagttttaaaaatgttcattaaacttaatggcgtttgttataggtttgtttttttttaaggagtcataagtgtaccactatggttttttaaaaatttattttcctgttttcattttctttataggaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcaattacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggaaaaaaaaattatttaaaaaattattaaaatataatattattttaaaaataaaaaaaaacctcaa

SEQ ID NO: 308701 - DNA, 1357 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgttatagaagtaaggcccatgcaagtggctgctattataactcccaagaactgcagcagta

SEQ ID NO: 308702 - DNA, 1329 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtaaggacattgccttattttgtttttgtttgttttggcgataagtcattgaaataactaaatatcagaaatctcctgcaatttatgtacctgcagtttgttcaagatttggtcatttcttccactgtagtatctaaaatgcagaacttcccactgtgtcaaagtaaattcaaggtatcttttgaaaatggagttcaagttatttttatgctttgtagcacggcatggagatcttgttttctccatatttgataataataaagcacatattttgatctta

SEQ ID NO: 308703 - DNA, 1021 bp, Homo sapiens
gctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttaccgggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacgtggttccctgtagtcatccatatattggtaccctgagtcaagtaaagttgtactccacaaatgttcagaaagaaggacagggatcacaaacactcagagtggaaaaagtaccatcatttgaaacagcagaaggtataggcgcagaactcaaagctccacttaagcaagaacctctccaagtaagagttaaagcagtccttaagaaaagggagtatggatcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggcctcagcaaaatggtgagacccatttctaaaaatgaaataaagacctttcccacgcccacagatatacaatcaccagtttggaaatgtctgcttcccaaaggtcatatggagaggcttctgggatgctggtaatgttctcttgatctggatggtggttacaggatatttgcctcgtaatattcattaagccagacattgccgtttcatgtacttgtctgactgcattttgtatttcataattttgaaaaaggcaaa

SEQ ID NO: 308704 - DNA, 749 bp, Homo sapiens
agagacatctcttgagctctctcccactgacttgtcattcacaggcattcaaactgtgatgtttgaaactgtctacctccgcagatccagggacagtccctccagtccaaaggctcactgcaattggccctcagcccccttcaaactggacttctggtttcttctttccttctgcccctgaattctgaagagcttcttcctgaggtccttctgccgcttcagcttctcctcctcctccttctgcttggctctgaagtgctctttattgtgcaggtgggtacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtacgtggccatggggcctttctgtgtcttgtggacatttacgtggtatctttagagcaaacacagagtggttgcataagctgcagtgttttagtatcggtgggactgtggcatggcgtagcaggagtgacagtcgcaaactgatggcccagctctgaccctccaggcaagtggactccgaggagtaccagcagatcttcccacatgcgtcggggagggctctggggagagtcagtgggcaggagagggtcagctgtgcaggctccagggcccagccccgtgctttcccctct

SEQ ID NO: 308705 - DNA, 356 bp, Homo sapiens
  misc_feature (2)..(2): n is a, c, g, or t
  misc_feature (83)..(83): n is a, c, g, or t
  misc_feature (128)..(128): n is a, c, g, or t
tnaaaaaggaataacaacgtggaacattatgccccgcgttaaccgcaaaggcagttgtaaggagcaccgcagcagcatgtaanctggctgtgccggaataaatgttgcacacaaggagccaagcaaancgagaagtggacagagccgcaatggttacaactgtaagaggttatttcttaaaagaaaaagaacacctaaggattgtttgccatattgggtgggtttactcttagaatcgcatgctgtagaaatgctcaaaagtgcatatgggactcagtcctagttcttgagcatttcacacgacgcgtgtacatatcccagatcgccgtaccagccgctttaaaaaaaaaccccgg

SEQ ID NO: 308706 - DNA, 1707 bp, Homo sapiens
aagatccaggctggtaccggcccggagatttacggatgaggcgtctgaggggcggacggaggcggcggcggcggcggcgggagcgggagcgggcggcgagtggggagcggggccgggagtggagcagccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaa

SEQ ID NO: 308707 - DNA, 318 bp, Homo sapiens
tggaagggaggcttgagtctgtgctgcaggagagctgggagggactgccagcaggtttggaaaggaaaggggtgctgaggcttgctttacactggtggaatctgaaaggattgaaccctcagagcgctgcagtgcgtagagctttctaggaactggggtacattcagggaaagggaataaggagtggatcctcgacttgagagaagaaccacaaaagaaccagttgagggttcagaagggggcgtgactgggtgtggcagatgtggagctgggttggtgagagcaggatgaggggctgttgctggctcctgagtgtag

SEQ ID NO: 308708 - DNA, 3152 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308709 - DNA, 3267 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaactaagaaaaaaaaccggggaaaatataggggggggagacaggggtttgaacgggcccgggcaaaggttttcgaccagttttggtaaaggggaaagagggggccccaagagaggaaaattggaacgggaacgt

SEQ ID NO: 308710 - DNA, 3415 bp, Homo sapiens
  misc_feature (3415)..(3415): n is a, c, g, or t
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggatacaacacaacaccacacacacaaaaaaaaaaaaaattttgggggcggcctgggcccaggaaaagttttaaaacacttcctggtggggcgccgcgggcgccccagagtactgcagaccttcggccaaacggtgcccccaagggaagtcggcggcaggacagggggtggtttctccacaaataaaaagccgcggcggacccgggggttctggacaatccagatggggtccgggggactagcggggtcttcacgggggtccaagagtcgtttacgcggcgcgggtgggan

SEQ ID NO: 308711 - DNA, 2917 bp, Homo sapiens
ctagaggatccccgatagtgcaacgtggtcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgaatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308712 - DNA, 3082 bp, Homo sapiens
ctagaggatccccgatagtgcaacgtggtcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaagccacgccatccctctgcgctcctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308713 - DNA, 3151 bp, Homo sapiens
  misc_feature (2672)..(2672): n is a, c, g, or t
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtttcttttttttttttttccgtttacntgttcctgatcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308714 - DNA, 2599 bp, Homo sapiens
ctagaggatccccgatagtgcaacgtggtcgctgagacaaatttacatgtattggagaccagaccagaagcccttctgaattaagatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308715 - DNA, 3098 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatggtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308716 - DNA, 3105 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308717 - DNA, 3419 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtaggtaatgcagcagcccaaatgcccttctctgaggagaactgtgcgtgtttctcatagaacatttgaagttgtcattaacggtttctagataaatgttgatgtagcattgatttggaattgtgttgtgggaaacgtttacagaaagctgaagtcacgtgccctcagctgcagacactcatgcagtgatgggaagagcagtgacctggctgtgcgtctgcacttagattctctgcctcttttcacatttctttaaactctgtttaaaacacatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308718 - DNA, 3173 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaatacaaaaggtggaaaggggtaaggctgcagagagctctacagagttgttggacggaagaggagagtgg

SEQ ID NO: 308719 - DNA, 3089 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308720 - DNA, 3063 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcaccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308721 - DNA, 2888 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgcccccgttcagtcattgatttgtcttcttctctatctcatgtggttcgtctacattctag

SEQ ID NO: 308722 - DNA, 3060 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcaggagagagagattctgcccagtcttcaagacagagttcaagatctagagcttccacatagctgtcccgggctactctgacccacagggcttcccctcgtgacccctctgaggtcttggggtttaactgggctttcactacgcattcattattgggttatatggttatatttaataagcctaaataaagtacaagcaactcaaaagaagggatgaatatggcggggcacaggggctcacgccttaaatcccagggtggagagaggggtaccgag

SEQ ID NO: 308723 - DNA, 2812 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacctgctttccaaacctgctgctgaacactggccttgaaatgaacaccaggacaatctgtggtcgagc

SEQ ID NO: 308724 - DNA, 3123 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308725 - DNA, 1814 bp, Homo sapiens
  misc_feature (1)..(1): n is a, c, g, or t
ngagcgcctctatgaggatcccatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308726 - DNA, 1578 bp, Homo sapiens
  misc_feature (1)..(1): n is a, c, g, or t
  misc_feature (4)..(4): n is a, c, g, or t
  misc_feature (10)..(10): n is a, c, g, or t
  misc_feature (13)..(14): n is a, c, g, or t
  misc_feature (22)..(22): n is a, c, g, or t
nccnttcctnctnntttcgggnacccttttttcttcgggtttgactgatcaaaaagaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308727 - DNA, 2293 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaaatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308728 - DNA, 2657 bp, Homo sapiens
  misc_feature (2550)..(2550): n is a, c, g, or t
  misc_feature (2564)..(2564): n is a, c, g, or t
  misc_feature (2566)..(2566): n is a, c, g, or t
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcaccattggagacagacagggggctaaccnggagggaaacacgntnttttttaaaaaagggggcaaactcggcacgtccgcttgtagcagcaaataataagcggacagagaagttgacattgtgacaacatatttgg

SEQ ID NO: 308729 - DNA, 2682 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctatatcggaagcagtacagcgcgcggctctacacgcttgggtagcgggataagtcactgttttctttatttctttaaaaaaaaaaaagttctgttgcaaacgactgctgttggattctgagggagaggggaggttcctcaagtgtgcggaagcgacacctgcaacagcaccacgattcaccaaggatcc

SEQ ID NO: 308730 - DNA, 1106 bp, Homo sapiens
cggacgcgtgggtcgacccacgcgtccggacccacgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaaaaagttctgttgcaaacgactgctgttggattctgagggtggggagggagagagagggagggagagggagtgaagagcctgccctcctatatggattcttcagggccctccacatctgaggtggctcattcccatcacacacagattgtcctggtgttcatttcaaggccagtgttcagcagcagcgtttggaaagcaggttctgtgggaccccccgccccgccccccgcactccttcatagcagcagtagtggcttctccatcctgttttctgcaacattctatacaaaactgtgctgtgaccttgcggtaggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308731 - DNA, 1664 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaa

SEQ ID NO: 308732 - DNA, 1591 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcg

SEQ ID NO: 308733 - DNA, 1690 bp, Homo sapiens
  misc_feature (1635)..(1635): n is a, c, g, or t
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtcgattcgcctcagttgctgctgtaataaaagtccacttttggncttaaaaaacatccccacacacacccccacagacaccccaccccaccatacaaag

SEQ ID NO: 308734 - DNA, 1858 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtgtcttggctgggcatgacaaccgcgtcagctgcctgggcgtgactgacgatggcatggctgtggcgacagggtcctgggatagcttcctcaagatctggaactaacgccagtaggtaatgcagcagcccaaatgcccttctctgaggagaactgtgcgtgtttctcatagaacatttgaagttgtcattaacggtttctagataaatgttgatgtagcattgatttggaattgtgttgtgggaaacgtttacagaaagctgaagtcacgtgccctcagctgcagacactcatgcagtgatgggaagagcagtgacctggctgtgcgtctgcacttagattctctgcctcttttcacatttctttaaactctgtttaaaacacatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcg

SEQ ID NO: 308735 - DNA, 1536 bp, Homo sapiens
aggctggggcttgtggtttttgtgagctgggagctgggctggggagttgttggagctgttggtgcctggtgatgttgatgcatgccgccgcggcgggactggaccgagcctcgccggcgcgcacctgcccgcagcgcccgcggagcgcgcagcgcggcccgagcgcgacgacctgccgagcggcggccgaggcggcggtgtgggcgcgtcaggccgcgacgagggcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttctttccaaatggcaatgcatttgccactggctcagacgacgccacctgcaggctgtttgaccttcgtgctgaccaggagctcatgacttactcccatgacaacatcatctgcgggatcacctctgtctccttctccaagagcgggcgcctcctccttgctgggtacgacgacttcaactgcaacgtctgggatgcactcaaagccgaccgggcaggtacgtggccatggggcctttctgtgtcttgtggacatttacgtggtatctttagagcaaacacagagtggttgcataagctgcagtgttttagtatcggtgggactgtggcatggcgtagcaggagtgacagtcgcaaactgatggcccagctctgaccctccaggcaagtggactccgaggagtaccagcagatcttcccacatgcgtcggggagggctctggggagagtcagtgggcaggagagggtcagctgtgcaggctccagggcccagccccgtgctttcccctct

SEQ ID NO: 308736 - DNA, 940 bp, Homo sapiens
  misc_feature (864)..(864): n is a, c, g, or t
  misc_feature (870)..(870): n is a, c, g, or t
ctagaggatccccgatagtgcaacgtggtcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacaggttacctgtcctgctgccgattcctggatgacaatcagatcgtcaccagctctggagacaccacgtgtgccctgtgggacatcgagaccggccagcagacgaccacgtttaccggacacactggagatgtcatgagcctttctcttgctcctgacaccagactgttcgtctctggtgcttgtgatgcttcagccaaactctgggatgtgcgagaaggcatgtgccggcagaccttcactggccacgagtctgacatcaatgccatttgcttcttcaatggaagcttgcatggttagagagcanctgagntgtttgacttgggtgacaggattagatatcagaatattggggaaaatggttacaagggaacctgggaaaa

SEQ ID NO: 308737 - DNA, 959 bp, Homo sapiens
ctagaggatccccgatagtgcaacgtggtcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagacgccaggaaagcatgtgcagatgcaactctctctcagatcacaaacaacatcgacccagtgggaagaatccaaatgcgcacgaggaggacactgcgggggcacctggccaagatctacgccatgcactggggcacagactccaggcttctcgtcagtgcctcgcaggatggtaaacttatcatctgggacagctacaccaccaacaaggtccacgccatccctctgcgctcctcctgggtcatgacctgtgcatatgccccttctgggaactatgtggcctgcggtggcctggataacatttgctccatttacaatctgaaaactcgtgaggggaacgtgcgcgtgagtcgtgagctggcaggacacacagcgcgtcagctgcctgggcgtgactgacgatggcatggctgtggcgacagggtcctgggatagcttcctcaagatctggaactaacgccagtagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaa

SEQ ID NO: 308738 - DNA, 838 bp, Homo sapiens
  misc_feature (39)..(39): n is a, c, g, or t
  misc_feature (63)..(63): n is a, c, g, or t
  misc_feature (72)..(72): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (89)..(89): n is a, c, g, or t
  misc_feature (104)..(104): n is a, c, g, or t
  misc_feature (123)..(123): n is a, c, g, or t
  misc_feature (126)..(126): n is a, c, g, or t
  misc_feature (129)..(129): n is a, c, g, or t
  misc_feature (134)..(135): n is a, c, g, or t
  misc_feature (137)..(137): n is a, c, g, or t
  misc_feature (143)..(143): n is a, c, g, or t
  misc_feature (167)..(167): n is a, c, g, or t
  misc_feature (218)..(218): n is a, c, g, or t
  misc_feature (245)..(245): n is a, c, g, or t
  misc_feature (248)..(248): n is a, c, g, or t
  misc_feature (280)..(280): n is a, c, g, or t
  misc_feature (289)..(289): n is a, c, g, or t
  misc_feature (313)..(313): n is a, c, g, or t
  misc_feature (345)..(345): n is a, c, g, or t
  misc_feature (352)..(352): n is a, c, g, or t
  misc_feature (364)..(364): n is a, c, g, or t
  misc_feature (373)..(373): n is a, c, g, or t
  misc_feature (395)..(395): n is a, c, g, or t
  misc_feature (399)..(399): n is a, c, g, or t
  misc_feature (418)..(419): n is a, c, g, or t
  misc_feature (514)..(514): n is a, c, g, or t
  misc_feature (517)..(517): n is a, c, g, or t
  misc_feature (525)..(525): n is a, c, g, or t
  misc_feature (527)..(527): n is a, c, g, or t
  misc_feature (536)..(536): n is a, c, g, or t
  misc_feature (550)..(550): n is a, c, g, or t
  misc_feature (559)..(559): n is a, c, g, or t
  misc_feature (562)..(562): n is a, c, g, or t
  misc_feature (571)..(571): n is a, c, g, or t
  misc_feature (590)..(590): n is a, c, g, or t
  misc_feature (594)..(594): n is a, c, g, or t
  misc_feature (597)..(597): n is a, c, g, or t
  misc_feature (602)..(602): n is a, c, g, or t
agggtgttttcttttttttcttttttatagaaaaataanccccttcttaaccagtttgttaancccaattgncggtntnttnttcccanctttcttcgtttgtntgtttttttttggtcaccnttnttnggganngncagttntcagccgcgccgggcttctaccancgccttggggttagccggggatttagtttatcttttttttcttttattttntttttaaaaataaaaaaaaaaagtttnttntttgtcaaaacatacttgcttttttggatttnctgttggtnttgtgggttgggttgttgtgttgntgatggtatgaggtgtttgattgttgctctgntcttctntttttggttttnttctggtgncctcttatttttttgtgtgttntttnttcctctttttatttcttnntacacagattgtcctggtgttcatttcaaggccagtgttcagcagcagcgtttggaaagcaggttctgtgggaccccccgccccgcccccttttntcntttatttntnttgtttttngcttttccttcttnttttttttnttnttttttttnttttttttttttttttttnttcnttntcttnttggcctggatctggcaaagagaatacaaatgaaaccccttctttctctttccgtccaacaactctgtagagctctctgcacccttacccctttccaccttttgtatttaattttaaagtcagtgtactgcaaggaagctggatgcaagatagatactatattaaactgtactgttatttaagatgtaataaagcagtttgacatgagggaaaaaaaaaaaacaaaaaaaaaaaaa

SEQ ID NO: 308739 - DNA, 597 bp, Homo sapiens
ctagaggatccccgatagtgcaacgtggtcgctgagacaaatttacatgtattggagaccagaccagaagcccttctgaattaagatctcacattcttgaaggtggcattgaagagcactaagatcggaagatgagtgagcttgaccagttacggcaggaggccgagcaacttaagaaccagattcgagtatgtagttgtgtgtgcttggttttattaatcatttgagtttcaggttagatgttacttgttttaggaaaaatggtttacaggatgacttgttctatgttttatatgaaattgaatcttagttggcccaggatgtactaattatagatctagatacttagcctagtacattgtttttgggattttgctttctgtatacaatttgttatttgaatatacaccagatgtctccgtagaatttataagtgtcttttgcattctttatcataaccttgaaaatttgtgataccctgggccactgatcagactgtgatatctacctccctcccctgaatattgggactattgacagcagaaaacttgcttaaaagtaagagtattaacaacaataaaaaaagtatttcaggta

SEQ ID NO: 308740 - DNA, 358 bp, Homo sapiens
aaagaaccagttgagggttcagaagggggcgtgactgggtgtggcagatgtggagctgggttggtgagagcaggatgaggggctgttgctggctcctgagtgtagggtaggcccgtaagttgcactccactcaggggctgagaacctgtgtgcatagcaaggcacacaagacattcacttttttttttttttcttaagagacagagtctcactgttgcccaggctgacatacagtggctcgctgctgccttcaactcctgggctcaaccagtcctcctgtcttagcctctggagtagctaggactacaggtatgcaccaccatgccaatttttttaaaaaatattttgaggccgggcg

SEQ ID NO: 308741 - DNA, 4102 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308742 - DNA, 4394 bp, Homo sapiens
acccctgccggccatggacttcctgctgcggcctcaggtgcgaggggtctgcgaccctctctccccatggcggcaagctccctgcgcctctccccgtcccctcgtcccacggggctgcttctggtgggagtggggctgggcgcttaggggagccaggagatggacaggagccttcctcacagaggggagaagccagccccctggcccgctcaccttctcttatccggtgttctgccagtcccagctgctccagtccccacctcgcccctaagacccgcccttcaccccagccctccccgcgctcttccttgttctggctgctggcaccgctatggagggggctgcatacccccgcccttggagatcccgatgcccttcaggtccagaagctcttgagcaaatatttggcggcgcctggagctgagaccgtgggtgggtggggggctggaccaaggctgcctggccaggcggctgccgcttagctgggctgagctcttacaagcgccgcattccctgccggctgtgccggccggccgctgctccgcgcccgcaggatgactcagccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308743 - DNA, 3837 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308744 - DNA, 4223 bp, Homo sapiens
cttctgtgccttcctctctctcagtgagtgagtggagttgagctcctgccctccacccagccagcctgcttccctcctgccggtccccaaggacctgggggagggaagcctcctgccggcctgtactggggagggggcaccccctccctgcaggggcatcttgggctctctccagagttcttccattcgtctgcttcctgtctcggcagcccggccccggctccacggggtgtctcaccctccccaccacaccctctctggtctcaggcccacctctggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308745 - DNA, 4304 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccaaaacaacaagaccaaaaaaacaccaccaaagcacaaaacagaaaacaaaagagggggggcctaataaacccggggggcgcaaagtaacacaccggtttttgaaacgggtcccattaggtgcgtataacacaagagcgcgcttacacctggcgagggaaggatcgtggctggagcccatgtggggtcagggacaccgagaaac

SEQ ID NO: 308746 - DNA, 3868 bp, Homo sapiens
acccctgccggccatggacttcctgctgcggcctcagccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308747 - DNA, 4260 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtgtgagggggcaggcaggggagggggaggtggggggatcaggtttgactgtccagcaaagaagggactggggtcctagtgggaggagtggggctagggggcaggatggcaggggagggacactgtgcctgccacagccaagtccccctcctccctgcagaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308748 - DNA, 3979 bp, Homo sapiens
cttctgtgccttcctctctctcagtgagtgagtggagttgagctcctgccctccacccagccagcctgcttccctcctgccggtccccaaggacctgggggagggaagcctcctgccggcctgtactggggagggggcaccccctccctgcaggggcatcttgggctctctccagagttcttccattcgtctgcttcctgtctcggcagcccggccccggctccacggggtgtctcaccctccccaccacaccctctctggtctcaggcccacctctggttatgcctccgcctcgttgccctgaaagccgcagcgacagcgaaaagggctaagattcggccatgagcagcgcccctcggcgccccgccaagggcgcagattctttctgtacgcccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308749 - DNA, 4360 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccaaaaaaaaaaaaacacaacacgacacacacacaactcgtgtgtgtgggccgacatgtggacctcgtcgaaaaaagatttttctcagacaccactcgctttggggggcgcggggacgcccagtgatgattaatcgcgcaacgtgcgccagcagcgtgtccccaaaagcaactcgcggcccagacctggggcggcgggtctttccccaccaattaaaaagcgcggggggaacacaggcggtctggaaccaatccagtgggg

SEQ ID NO: 308750 - DNA, 4705 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccaaaaaaaaaaaaaaataaaaaaaaaaaaaaaagaaaaagcccaacaagagaaccacaactatccaacaaccaacaaagggagggcggcaaggcagctaaagacgaacaccaccgcaggcggcggcgcacaccatacaaactaagaaccgacacaactgtagaaagagacgcgcaaacgaacacatcggaggccgaaacaaaacacgaacaaagcacagaagcgacagacaaacaacaccagccggacagcgcatagaaaacaacgccaccagatgcggcctcacctgaaggagccgcaaccaccacacacagcatcggtgatgcgagaaagccggcgacgaacagacacccaacacggcacacagcaccaccaacgcgaactcagaaccaccagacgtagcgacgagtgcacaccgaagaaacgacggacccgtcagaacaagctaggagcaaggctacagcagaaacacacaaaacacccggcgaccagcacaacgcagaccgaacgacacccctcaccgcacgcacgcagcgacagcacgtatagatataacagaccccgacacgccaactagacgagcacggaaacaacagccgcacacgc

SEQ ID NO: 308751 - DNA, 4424 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggcccccaaaacaaaaacaaaaaaaaacttctctggggattcttatgtgttggggagttggggagaaagggggttatgtgaactgggcccaatgtggctcattagcgtgtttctcctgtgacccagtttccttgtggtcccacagggtggttagtaaccttgcgggttctccccatattaggtgagtctgcggtatttagtttgtcgaataagcccgggtttaaccccgggcatttacgtgacttccgcaaaaccgggacaaagaatgccagaaccggaatggtgagagcacacgcgtatttacggcaacgaaacactaaaaggatacac

SEQ ID NO: 308752 - DNA, 4012 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308753 - DNA, 2326 bp, Homo sapiens
aggcactttggtgttcactgctgttcacaagggcgactctgggcagtactactgcattgcttccaatgacgcaggctcagccaggtgtgagcagcaggaggaggacgtcctcctcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308754 - DNA, 2316 bp, Homo sapiens
gagacggagtctcactctgtcacccaggctggagtgcagtggcacgatcttggctcactgcaacctccgcctcccaggttcaagtaattctcctgcctcagcctcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308755 - DNA, 2160 bp, Homo sapiens
tcccccatccccatgctgctttggcagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308756 - DNA, 4339 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtgagccccccagctccccaccggaaggggtgtgcctctggccatcctggtctacttgggtcactctccagctgccccctcccatctgcccagttcagccagcccccacctcctctctgtaccaacccagctctggcacctaggaatgttcttccatccccgcctccgaagaagagagaggctcttcccagcagcaggctagggaggaagctgggctcacctgtctccgccccccaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308757 - DNA, 4202 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtgtaagccctcccgtctgcctcccccggttcctcttgcctccctgtggatctggaaaggcccccccacttcccttcttgaccgccacctccccacacacagctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308758 - DNA, 4439 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtgagccccccagctccccaccggaaggggtgtgcctctggccatcctggtctacttgggtcactctccagctgccccctcccatctgcccagttcagccagcccccacctcctctctgtaccaacccagctctggcacctaggaatgttcttccatccccgcctccgaagaagagagaggctcttcccagcagcaggctagggaggaagctgggctcacctgtctccgccccccaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtgtaagccctcccgtctgcctcccccggttcctcttgcctccctgtggatctggaaaggcccccccacttcccttcttgaccgccacctccccacacacagctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308759 - DNA, 3894 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtcccggacctccggatgccctggtcacggcctgcaggtgtcttgctggcctggtctgggccggctctgcacagcttgctccctgggcttcccttaatctcatctcacagtgcggtccgatggtgtgtcacccgtttttccgacggaagatgaagctggtgctaccaggcaccggttgaaccgggggtgggcaacaggagccg

SEQ ID NO: 308760 - DNA, 3767 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacagccacccaagtgatgagaaggacttctccttcccccgcaacatctcagctggctccctgggctccctgctggggcatcaccatggtcagggggctgagagtgacccccacgtcaccgagcctctcatgggaggtgttcctgagacccggctggaggtggagcgagagcgtgagctgccgcctccagcaccaccagctggcatcacccgctccaagtccaagcacgagctgaaactgctggagaagattcctgagaatgccgaggccacggtggtccttgtgggctgcgtggagttcctctcccgccccaccatggcctttgtgcggctccgggaggctgtggagttggacgcagtgttggaggtgccggtgcctgtgcgtttcctcttcctgctgctgggcccgagtagtgccaacatggactaccacgagatcggccgctccatctccaccctcatgtcagacaagcaattccacgaggcagcctacctggctgacgagcgggaggacctgctgacggccatcaacgccttcctggactgcagcgtggtgctgccgccttcagaagtgcagggcgaggagctgctgcgctctgtggcccacttccagcgccagatgctcaagaagcgagaggagcagggccggctgctacctacaggggctgggctggagcccaaatctgcccaagataaggcgctcctgcagatggtagaggcggcaggggcagctgaagatgatccccttcggcggacggggcggccctttggggggctgatccgagatgtgcggcgccgctatccccactacctgagtgacttccgagatgcacttgaccctcagtgcctggccgcagtcatcttcatctactttgccgccctgtctcctgccatcacctttggggggctgctgggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtaccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308761 - DNA, 1400 bp, Homo sapiens
aactgatgtatgagtcagagtcctgggtgtaaatttcagtaccagggtgaaggatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308762 - DNA, 1778 bp, Homo sapiens
gttttaaaactcacattttttaataacaaaggtacatgcttttgttaaaatgtcaaacaatccaggagtgtagaaaggggaaaggctccagaggtgacagtcagtctgggcatcagatgtgtgtgacaggccactcagtggtcctctgtgctcatgtcctcttcctttaggcccctggatcctctctgggcctggctggtgccactcaccactgccttcctgacttatactagccgcttggtcttttctgccccacactgccctgtgctcacagctggttctctgggtcattgtcttaattcaacaagacaagctccttgaaagcaggccagcctttcccctgccccaccccttccacccgacactcactgagccccaggaatcttttctgcagtccagctgatggaggccgtgtggcctcctctccccagatcttccaggagcaccccctgcatggctgctcagcctccaacagctcagaggtggacggcggtgagaacatgacatgggccggggcaagacccacgctggggccgggcaacaggagcttggctgggcagtctgggcaggggaagccccggggccagcccaacacggccctgctgtcgctggtgctcatggccggcaccttcttcatcgccttcttcctgcgcaaattcaagaacagccggttctttcctggccggatccggcgggtgattggggactttggggtgcccatcgccatcctcatcatggtgcttgtggattacagtattgaggacacctatacccagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccacgctcatcatctccaagaaggagcgcatgctgcagaagggctccggcttccacctggacctgctgctcatcgtggccatgggcggcatctgtgccctctttggcctgccctggttggctgctgccactgtccgctctgtcactcacgccaacgcgctcactgtcatgagcaaggctgtggcacctggggacaagcccaagattcaggaagtcaaggagcagcgggtgacggggctgctggttgccctgcttgtgggcctctccatagttatcggggatctgctccggcagatccccctggccgtgctctttggaattttcctgtacatgggagtcacctcccttaacgggatccagttctatgagcggctgcatctgctgctcatgccgcccaaacaccacccagatgtcacttacgtcaagaaggtccggaccctccgtatgcacctgttcacggccctgcagctgctctgcctggccctgctctgggccgtcatgtccacagctgcctccctggccttccccttcatcctcatcctcacagtgccgctccgcatggtggtgctcacccgtatcttcaccgaccgagagatgaaatgtctggatgctaacgaggcagagccggtgtttgatgagcgggagggtgtggacgagtacaatgagatgcccatgcctgtgtagccgccaccgagggacagccgagggaccgatggacgaggggacaggctggtgggatggggttccccctcccatgcccctccctcctttttatttaagtgaataatttaaagtcttctcctcccccactgcccctgcagtaaagtgctttggccccca

SEQ ID NO: 308763 - DNA, 1936 bp, Homo sapiens
  misc_feature (61)..(61): n is a, c, g, or t
tgcccgcggcgcggtgggaaagttgagttgggagaagttgggagcggcgggggcgcgcccnggggtgggcacggggcagtcgtcgggagcgcgcgagtgcgccggaggacggggagagaccccgagacccccggggcacgaagtccagagcgagcgggttatgcctccgcctcgttgccctgaaagccgcagcgacagcgaaaagggctaagattcggccatgagcagcgcccctcggcgccccgccaagggcgcagattctttctgtacgccagagccagagagcttgggccctgggacgcctgggttccccgagcaggaggaagacgaacttcaccgcaccctgggcgtggagcggtttgaggagatcctacaggaggccgggtctcgtggaggggaggagccaggccgcagctatggggaggaagactttgagtaccaccgccagtcctcccaccacatccatcacccactgtccacccacctgcctccggatgcacgccgccgcaagacaccccagggcccaggacggaagcctcgaaggcgcccgggagcctccccgactggagaaaccccgaccattgaggagggggaggaagatgaggatgaggccagcgaggctgagggggcccgggctctcactcagccgtcccctgtctccacaccctcctcggtgcagttctttctccaagaggatgacagtgctgaccggaaggcagagaggaccagtccatcttcccctgcaccactgccccaccaggaggcgactcctcgggcctccaaaggggcccaggctggaacccaggtggaggaggcggaggcggaggcggtggcggtggccagtggcactgcagggggtgacgacgggggtgcctcggggcgccccctgcccaaagcccagcctgggcaccgcagctacaaccttcaggagaggaggcgcatcgggagcatgactggggctgagcaggcactgctgccccgggtccccacggatgagattgaggcccagacgctggccacggccgacctagacctcatgaagagtcaccggtttgaggacgttcctggggtgcggcggcacttggtgcggaagaatgccaaaggttccacacagagtggccgagaagggcgggagcctggccccacacctcgggcccgaccccgggccccccacaagccccatgaggtgtttgtggagctgaatgagttgctcctggacaaaaaccaggagccccagtggcgggagacagctcgctggatcaaatttgaagaggacgtggaggaggagaccgagcgctgggggaagccccacgtggcctccctctccttccgcagtctcctggagctccgcaggaccctggcccatggggctgtgctcttggatctggaccagcagaccctgcccggagtggcccaccaggtggtggagcagatggtcatctctgaccagatcaaggccgaggacagggccaacgtgctgcgggctctgctgttgaaacacaggagagaagacacaggacctgataggggtgtcggagctgattatgtccacagcgctccagggcgtggtcttctgcctgctgggtgcccagcccctgttggtgatcggcttctcagggcccctgctggtctttgaggaggccttcttctcgttctgtagcagcaaccacctggagtacctggtgggccgtgtgtggatcggcttctggctggtgttcctggccctgctcatggtggccctggaggggagcttcctggtccgcttcgtctcccgcttcacccaggagatcttcgccttcttgatctcactcatcttcatctatgagaccttctacaagctggtgaagatccttccagagagcaaccccccttgccattgggcttgcggtccaggcccttccccaaagcaaggccgttccaggaaggggcttgggac

SEQ ID NO: 308764 - DNA, 645 bp, Homo sapiens
caacacggccctgctgtcgctggtgctcatggccggcaccttcttcatcgccttcttcctgcgcaaattcaagaacagccggttctttcctggccgggtgcgtgggcttaaaggccaagagggggttaggggcaggaaggggggtggcaggaagtcagcggctgtggtggcaggactctgagcgctgtgcctgcccactcagatccggcgggtgattggggactttggggtgcccatcgccatcctcatcatggtgcttgtggattacagtattgaggacacctatacccaggtaaggtgctgcccacagcaggcaagtgctgctgcctctgccaccccgggtctaggtgttcccctccagcctccaaacccagcctgtccttaagcttaagcctgtccttaagatgccatcccctttccatggcatgccctccacattcaccttaacccttgtccctacactgtgtctgccctgcagaagctgagcgttcccagtggattctcggtgactgccccagaaaagaggggctgggtcatcaaccccctgggagagaagagccccttccctgtgtggatgatggttgccagcctgctgcccgccatcctggtcttcattctcatcttcatggagacacagatcaccac

SEQ ID NO: 308765 - DNA, 499 bp, Homo sapiens
gtgtcgaccctaaacagcacagtataacaactatttacatagcatttgcattgtattaggtatcataggcaatctagagatgatttaaagtatacaggaggatgtgggtaggttatatgcaaatattacaccagtttatataatagacttgcacatccgtggattttggtatccacaaggtgtcctggaaccgattccccgtagataccaagagacaactgtatttggaaagcttcagaagctttgcagatgaatgcagaaggctgggagtcagtgggagctttcctaacctcagaacagccattcatttgatctgtgtctagaatgagagtttctctgtgtgagctatgggtgattaatccattttgccttcattcttcagtggtttggcatatagattgaagtgttttgcttttctatttattggcggaggcaaatagaaacagagctctctctctctctcttgcagtgtacccacactccaaagtgccataaaacg

SEQ ID NO: 308766 - DNA, 1598 bp, Homo sapiens
  misc_feature (2)..(2): n is a, c, g, or t
  misc_feature (330)..(330): n is a, c, g, or t
  misc_feature (672)..(672): n is a, c, g, or t
  misc_feature (711)..(711): n is a, c, g, or t
  misc_feature (738)..(738): n is a, c, g, or t
  misc_feature (745)..(745): n is a, c, g, or t
  misc_feature (752)..(752): n is a, c, g, or t
  misc_feature (804)..(804): n is a, c, g, or t
gngctttttatttcatttattgagttcttccattccaggattatgtacttttgttatcttatatgtcttaagtcacactgagtttctttaatgtcattttgatttttttgttaggcatttcaaaatttggggggagcatctgttactgaagaattattgttttcctttgaaggtgtcatgttttcttgcttttcaatgttttttgtatcgttatatttatatctgtacatctgatgtcacttcttcctattttatgcattggcttttgtagggaaagactttttcctgtagatgtagctatagtgttggttggatagggtgctttggctntgattctgggtgagtgcagtagtatagtctccctgtgatttcttcagctttaatgagcattagcggtgtctgagagtccctcagtggcttagactgtggttgttaatgaaggctgtagtaggcttttctggggactgtgactccaggtagaccagtgctcaggcactagtagttgtgccagtaggcagggcatgcctttcctcaggcccctagatagtacatgtgggcgccagcaggcataggcagagcataacagtacttaaggccccagatgaaatgcacaggcaccaacagcaggcagaacaggcctgtcgtcaggccctctgatggtgtatgcaggcnatggcagcagcgtgctagttgagtcagtcctcaggcccntagatggcatgcttaggcacagttganagtggcngtgggcngagcaggcttgtccttaggaccctagataatgtgtgctggtggcagtggtgngcagggcaggcttctctccaagcccacctctggagtttgcaggtgctggtggcaggcaggtgggttgacctcctggcactatgtgcacaggtgacagcagcagtaggtgggttagacccttttcaatcccactttagagctcttcagttagaagttagtttatggtgctcctttttctaaccgtaagtcattataaaatacaggtttatcagttattttttggcatatttaacacatttaaatgggatgaacagctttttagtttataataggaagctaataaaaatcaaatctaatttgtttcattttgttttgttttttgagacagagtcttgctctgtcacccaggctggacgcagtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308767 - DNA, 3993 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308768 - DNA, 3630 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308769 - DNA, 3920 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagatctcgctcgggtcctctgatcgccc

SEQ ID NO: 308770 - DNA, 3683 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308771 - DNA, 3514 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308772 - DNA, 3575 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308773 - DNA, 3482 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308774 - DNA, 3770 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcaggtgggcaggagggtctccgactccagagacctgagcttttggggcgcgggtgggagcgcgggggaaccctcaagacggctttcttttggcgactgagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308775 - DNA, 3360 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaagaatctcagtacaagtgaaggtgtcagtaaagaaatgcatcaccttcagcgcatgttcttacagaattgctgggaaattcctacttatggagcagcatttttcacaggacagatatttacaaaggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308776 - DNA, 2615 bp, Homo sapiens
  misc_feature (2573)..(2573): n is a, c, g, or t
  misc_feature (2597)..(2597): n is a, c, g, or t
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggtttttggctttcatcgctttttctacatgtttttagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttgttgcatgaagttcccattgaaggacagaaaaaaaagagaaagaaagttttattggaaacgaaacttcaaggcaacagtgaaataacacaaggcatattggattacgtagtagaaaccaccaaaccaatttctcctgcaaaccagggtatcagaggaaaacgagttgtactaatgaaaaaatttcctctggatggagagaagatgggcagagaagcatcattatttattgttccatcagttgtcaaagataatactaaatacacatataccccaggatgcccaattttttactgcttacaagatattatgcgagtctgtagtgaatccagtactcattttgctacacttacagcaaggatgttaatagccttggataagtggttagatgaacgtcatgcacaatctcactttattccagctttattccgaccttctcctcttgagcggataaaaactaatgtcataaatcctgcatatgctactgaatcaggtcagacagaaaactcactacatatgggctatagtgcactagaaataaagagtaaaatgttagccctagagaaagcagatacctgtatttacaaccctttgtttggatcagatcttcagtatacaaatcgggtagataaagtggtaataaatccatactttggtctaggagctccagactactcaaaaatccaaatacctaaacaggaaaaatggcagagaagcatgagcagtgtcacagaagacaaggaacgacagtgggtagatgattttcctctccaccgaagcgcctgtgaaggagattcagaattactaagccgtcttctcagtgaaagattttcagtcaaccagttagatagtgaccactgggcacccattcattatgcatgctggtatggaaaagttgaggccactcgcatattgttagagaaaggaaagtgcaatccaaaccttttaaatggacaacttagttctcctcttcattttgctgctggaggaggacatgctgaaatagtacagattctcctaaaccacccagaaacggatagacatataacagaccaacaaggaagatctccattaaatatttgtgaagaaaacaaacaaaacaactgggaagaagctgcaaaattgttgaaggaagcaattaacaaaccatatgaaaaagttcgaatatacagaatggatgggtcatatcgttctgttgaattgaagcatggaaataataccacagtgcagcagataatggaaggaatgcgtctctctcaagaaactcagcaatatttcactatatggatttgttcagaaaacctcagccttcaactcaaaccatatcataaacccttgcaacatgttcgtgactggccagaaatacttgctgaattgactaatctggatcctcaaagggaaacacctcagctttttctaagaagagatgtgagacttcccttggaagttgaaaaacagattgaagacccactagctattcttattctctttgatgaagccagatataatttattgaagggcttttatacagctcctgatgctaagctgataacattggcaagtctgcttttgcaaatagtctatggaaattatgagagtaaaaaacacaagcaaggtttcctaaatgaagaaaatctaaaatccatcgtacctgttaccaaactgaaaagtaaggcacctcactggacaaatcgcatacttcatgaatacaaggaatcttaagtnccaaggtggaaagggggtcaggtnaaaggaaaaggcctttaa

SEQ ID NO: 308777 - DNA, 1142 bp, Homo sapiens
aaaaaaaaaaaagaagaaggagaagaaattttaaaaaatgaacaaagtgtatatgacatatgggacaccataaagtgactaattcaaattttgagtgttccagaaggtgaagagaagcccaaaaggcatagaaaatatctatggcaagccccagcaatcataaagtcatccctgtgtatgtaggagtgaatataaaaggacttcatctcctcaacatggaaactaaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308778 - DNA, 934 bp, Homo sapiens
gtttccaattatgttgcaggctttactcatcagtcttaagtatggttgttttatgtggcaattgggagatactgatacttgttttcagatccatagcatggaaaataaaatgagctttatagtacatacaaaacaggctggtctcgtggtaaaactgttaatgaagctaaatggacagttaatgcccactgaaagaaattcatgaaagagaagtaactgttactcaagccaccacattttgtaatgcagagttttttttccgtgaaagatttcttaaaatattacttttggccgagcatggtggctcacccctgtaattccagcactttgggaggctggggcaggcggatcacctgaagtcagagttcaagaccagcctggccaacatggtgaaaccctgtctctacaaaaatacaaaaattagctgggtgtggtggcgggcgcctataatcctagctactagggaggccaaggtgggagatcgcttaaacccaggaggtggaggttgtagtgagccaagattgcaccacggcacgctagcctgggtgacacagcaagactccatctccaaaaaaaaaaaaaaaattactttcaacaaggcatatagtctcttgtaatatatatgtatactattacattgtacagaatctgtacttatgtttggtgtgtaatataccaattagttttatataatatcctcataagctattctaatttttgagagaaacacaaaaagttatagattgatagtctgtataatattagacaaaatagtaagctttataaaaagttatttttggtaaatggtaaggaatttggggtggaatgtgatgagattaaaatgtagctttggtataacttcatgtgtatttcaaaatatactgaacgtcaacatgatttgaataaagaaaatgtattttctacttgaaccaca

SEQ ID NO: 308779 - DNA, 816 bp, Homo sapiens
gtctcctagtcgcctgccaccagcccctgagagactgcaggtccagtgaaaaggagcaggaacggcagcagcccggccgccgacccggaagctctttcaccgccaaccgcgaggctgcaaagggtgtgaacccggaagcgatttcatagccacggtaacggcggggtggaaagctaaggcctttgaagacctgggaccccgtagtttcgggagagggtgaggggtgaatggtgctgaggtgcgaggagagggaaggacagtaaagagcagcctcaccagaagtctttcatctcggtggtccaactcaggatctcagcctcattattttcttacccttctggagtgcatatgtgcctttacagtttctgtttgcaaacgctgtctagcatactaagaggatgttagcaaacctgttccatggacactaaatggcagttgtacatctcccctcatcagtcatagtgacaaccagaaatgccctccatattttccagtgatcccagtcttcaatgcgtctgtctcataatttgtaaacgtttattatcttgaagtcattgttaatctgtggtgaaaagtaattgctaaatagaaattctgagaagaaaaaggcctcatccttttcacatgatgtaggaaggtctgttgcatgagcaatgggaaatccagaaaacatagaagatgcatatgttgctgttattcgtccaaagaatactgccagtctcaattctcgggaatacagagctaagtcatatgaaattttcgttgcatgaagttcccattgaaggacaacagaaggaaggtgaagaaaataagctc

SEQ ID NO: 308780 - DNA, 324 bp, Homo sapiens
gagggtttttctgccacaggaagctgggccgggctgctgtgcctgggaggagggaaggaggaatgagaaagcggtgacggtccctgccccccctcgccaggtgactgtcccacccatttagttgaatgtagcggccagagaggcactcgcggcagcccgtacgggtgggacctctcggtgtccttcgggaaacaggaggagcaagttcgactccagcgagggaaaacggaggtgggagactgaaccatctccacatctagttgccccaggcaaggagtttatttttcacatgtagttacagagaaaccatagccactttttggg

SEQ ID NO: 308781 - DNA, 2372 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccagcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctctgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 308782 - DNA, 636 bp, Homo sapiens
gaaagttatacttaaataggaaattcatttttgagaaatagtaatttaggaagaagacctttatgacattttagatgtcactttgcttgatatatttgctccctctagtgagtattcctgcccttgtttgcaatattttacagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaaggtttgtaatgtcttttctttttgaggcgatgtgttagatgatcagcttacgggggtttgttgctgaaggcggttgctaaggtttaaagagtaattttagtttaaaagttggtgaagtctagtgctatgtgaaatagaagaaggaattgttttcctaggccactaatatataggaaacagtgaaatgatggttacatttaagatgagatttttaaaagttaaaggtttttaaggaaagtttattttttgatgatagcaatagattttgtgattacagccgtatgtttaggtagaaaattttaaaaacacaaaaaagaaaa

SEQ ID NO: 308783 - DNA, 453 bp, Homo sapiens
gtaacatcaacaacaaaacccaaatgtaaagggaactgcaagtgtaatcactcagcttttatttttctctagctataccaaatggttttggtaccagtccactaactccctctgctaggatatcagcactaaacatcgtgggggatctcttacggaaagtaggggtaagtttcaattatttatcactaggtgtgtccactgacaaggtattgaattatttcttaatttgaagtgagggaagaaagaaaggatactttcctgtggtaaaggctgtcatgaagctcagaagcaaaagcatccattgactagccaagtccagatgacacttcatgatgcccctgcagaagagcctgtaccttgaactctgaggttcccaccggagcattcttcctgttccccactcctgtttcaacagcacgatgcctctgtccttgtctagaatactttgtctaa

SEQ ID NO: 308784 - DNA, 2270 bp, Homo sapiens
gtgcctgaacggtcaatctagaggatcccgaacgggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctctgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 308785 - DNA, 2788 bp, Homo sapiens
cggcgccgaggcctgcccttggggagccttcccggcccggggccgtgtctgaggctccgccggggcgggccgggccgggttccggggcggccagcctgggggcaactgttccaaccgctctaactgtcccctcccttccctggtccgatgtgtggccccccaggggcgcctgcaagggaacgattccggtggcctccggaagatgtgccccgttccgggtagggtgagggctggcggtgacggaggccgggacgtggcaccgtgggctggggcgctggcggcgcaaggagtggcccagtcggaggtggcagcggcgcgcccagcccgcctcctcctaccccctcttcgaaattccttcatttgcgagggtggcttggagcggggttgcattttgatctctcagtgcctctctcccatggggggcgagagcgcgagcagcccacgttgggctcggattggcattctcctgactcccgcccggaactgctaatcatcctccccctggagttcggcaaagtgtcaccaacgggctcgggttacttgtgctcgactcttttcttgctgtaagccatgagatgaccctttaagttttgcaaaggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctctgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 308786 - DNA, 2407 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccagcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaagggcaagaaaaagtcatatttcccacgttgttcatggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctctgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 308787 - DNA, 2145 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccagcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggtgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctctgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 308788 - DNA, 2625 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccagcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctctgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaaggattgacgttgctttattcagtctctgccatcccatgagaggagagctggggcccgtaaagccaggttccaacgtcactgctgctctgacatgggacacgcagctgtggaatgggacagagatcaggtggcctccggagatgtcttatgtgcggagcaggcgtcctcatgctgtttcttggcactggcttctgggcttggctgtgatttccaggagcagtttgagaatggcctgggccccatgtgaaaatct

SEQ ID NO: 308789 - DNA, 2888 bp, Homo sapiens
  misc_feature (2375)..(2375): n is a, c, g, or t
  misc_feature (2378)..(2379): n is a, c, g, or t
  misc_feature (2400)..(2400): n is a, c, g, or t
agaatggcctcggacacccaggcagtccctgacgtgtcggggaggagccgggcgcggaggtacgctgagtggagctcggggctgcgtaggggagctgagccgagcggctgggcgggcctggccgggccagcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctggtctgggctcctcgcgtccatcgtcagcgccgggtatgctgcctctcagtgtgtgagtgcctagcctccaggtgggggctcctgccctcctccaacaacccaggacacccacgcctcacccctcggtgcctgggcccagccccgtgcccctccgtctgcctccgcacggctggcagagggcaggctgcatgcagtggcggctactgggccctgcccagccccggaactctgcgcgatatcaatactggctattttctcttctcgccgtagtgccgttggtttcacatgattgcacttttgtgggtcgcaaggtgatacatacgtgtattacttggtcactggatgcagaagtacccattcatcacacctgccccatagcccccactctgctgtactgataggatttagttgtgttttaggacattgcaaatcttctagaagttctcccccaaatcaggtcaatgtgtgccctcctgagctcccacccaggcatctccagtgctcatgatcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctctgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaaagnaannaaaaaaaaaaaaaaaaaaaanagaaaaaaaaaaaaaaaaaaaaaaaagagagggggcggcgcgcccccagaaagatctcccccgcggggggccccagcccgccgcgccccccgttcgcgtgggaccaggggtggcccccctattggcgaggcggcgatatttatagcaccgcggaggaccagtgggcgcgcagctgtttaaaccaactgctggaggaggggcgtaaaaacgcgggcacaccgtggggcgacacctggggagaaggagaccccttacactccgcgggggggggtgaaaccaatatgcgccggcgcacagaacacccccccacacagcagaacatatctacagagacgcccgtaggacaggacaacattaagagagtgtagaagcggggcaccacaggggggggggtcaacccacagcacgcgggctataccccgcgcccccggcgtcaagacaagagcgaggccccaccgagcgacagacacctgtcggcgacaaccgct

SEQ ID NO: 308790 - DNA, 746 bp, Homo sapiens
caagtccatggaatggtagctgcttaagtaaaatcagaaggtgcagaaaatgttccctaattcatgtgtcccccaactccacccctcacagtttgggcctgtttctggcaaagagtcaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctctgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 308791 - DNA, 947 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccagcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggttactgaattagggaacattttctgcaccttctgattttacttaagcagctaccattccatggacttgcctcccagagcagcacaatgcccgtctgagccccacgtggcaggagcctctgggacggggcacacacaggcccagcctctgtgctgtctcctcctctgtgcgcctcagactcggggtgagggaggcgggcagcctctcgccagccttcccgtccttcagttcaacgacatctttggagtgtttttgttttctcttccaagggccgtcccgttgtgttaggaagggtgagtggctggttccagggtgggccggtgccagctccggggtggactgaacagcggcggctgtccctgtgcatcctttgattactctcatgctgcatttactgtttacatttgttttattgtacataggtttgtaaacattattgcctgagatatttgtatataacttgggctttgtagcttttatttattcagaacgcatacggcatgttaatgactctgatggtgtcctcctctgggcagctgtataggatcatcatgtggttacaaaaaatacttccctcaaaaaaattcttttaatgtggaaacaataaatttcacagaaaaaaa

SEQ ID NO: 308792 - DNA, 1273 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccagcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggctttagaatccaaattagcagcttgcaggaattttgcaaaggaccaagcatcacgaaaatcctatatttcagggaatgttaactgtggggtgctgaatggcaatggcacaaagttctctcgatcagggcatacatctttcttcgacaaaggggcagtaaacggctttgaccccgctcctcctcctcctctgggcagctgtataggatcatcatgtggttacaaaaaatacttccctcaaaaaaattcttttaatgtggaaacaataaatttcacagaaaaaaa

SEQ ID NO: 308793 - DNA, 1278 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccagcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaagctataccaaatggttttggtaccagtccactaactccctctgctaggatatcagcactaaacatcgtgggggatctcttacggaaagtaggggtaagtttcaattatttatcactaggtgtgtccactgacaaggtattgaattatttcttaatttgaagtgagggaagaaagaaaggatactttcctgtggtaaaggctgtcatgaagctcagaagcaaaagcatccattgactagccaagtccagatgacacttcatgatgcccctgcagaagagcctgtaccttgaactctgaggttcccaccggagcattcttcctgttccccactcctgtttcaacagcacgatgcctctgtccttgtctagaatactttgtctaa

SEQ ID NO: 308794 - DNA, 1216 bp, Homo sapiens
agaatggcctcggacacccaggcagtccctgacgtgtcggggaggagccgggcgcggaggtacgctgagtggagctcggggctgcgtaggggagctgagccgagcggctgggcgggcctggccgggccagcggaggggagacgtcggttgagcggcggcgaacatgcgcttttgacacattggaggctttcttgatcatggatggtgaagatataccagatttttcaagtttaaaggaggaaactgcttattggaaggaactttccttgaagtataagcaaagcttccaggaagctcgggatgagctagttgaattccaggaaggaagcagagaattagaagcagagttggaggcacaattagtacaggctgaacaaagaaatagagacttgcaggctgataaccaaagactgaaatatgaagtggaggcattaaaggagaagctagagcatcaatatgcacagagctataagcaggtctcagtgttagaagatgatttaagtcagactcgggccattaaggagcagttgcataagtatgtgagagagctggagcaggccaacgacgacctggagcgagccaaaagggcaacaatagtttcactggaagactttgaacaaaggctaaaccaggccattgaacgaaatgcatttttagaaagtgaacttgatgaaaaggaatctttgttggtctctgtacagaggttaaaggatgaagcaagagatttaaggcaagaactagcagttcgggaaagacaacaggaagtaactagaaagtcggctcctagctctccaactctagactgtgaaaagatggactccgccgtccaagcatcactttctttgccagctacccctgttggcaaaggaacggagaacacttttccttcaccgaaaggtttgtaatgtcttttctttttgaggcgatgtgttagatgatcagcttacgggggtttgttgctgaaggcggttgctaaggtttaaagagtaattttagtttaaaagttggtgaagtctagtgctatgtgaaatagaagaaggaattgttttcctaggccactaatatataggaaacagtgaaatgatggttacatttaagatgagatttttaaaagttaaaggtttttaaggaaagtttattttttgatgatagcaatagattttgtgattacagccgtatgtttaggtagaaaattttaaaaacacaaaaaagaaaa

SEQ ID NO: 308795 - DNA, 604 bp, Homo sapiens
cgcttggagtctctcaaaaacactcttttttttcccataactttatgtagtttcttaggtaacatgtgctctatttttgtaagccactctgagttcttttgggctgtgtgtaggtgggcatggactaattttagggcgtgatgtggaaatagtattcgtattactgtttaatatgttctcctttcttttattaggcaagaaaaagtcatatttcccacgttgttcatgggtaactgaatttgtttgctgtgctctttttcattctttcttaatcctggtgtgtggtggaagacacattaacaatctggttttactaactgcatggggctgactcagctttaaccaacttacagcccatcagtgaactttcacggtcctgttcgacttgactgtatgccgttattagttcagctgtgagaaacaagaacaaattagttgcagtggtcctggggtggctgggagtagcatgccaggtggcacgcctgagatgggctagggcgctgtagtgttgatttcagagtctggcgatgggggtttgaggtcactgtcaggccctgggatcacctttgactgtcttcctgggactgggggtcttcccgttacc

SEQ ID NO: 308796 - DNA, 3488 bp, Homo sapiens
taaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtccaaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactcta

SEQ ID NO: 308797 - DNA, 2426 bp, Homo sapiens
tctaagcgcctctctctctctggttacactacacgctctctctagatacatatcttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtccaaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactcta

SEQ ID NO: 308798 - DNA, 3920 bp, Homo sapiens
taaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtccaaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactctatcttactccaagaagtctctttgttctccctccccctttcttgaaccctaggaataaaatggcagtttctctcaaggtcttcctgtggaattcccccacaggctgggagagccacaaagctgagagactcttatcacaaaatctttaaatgaacctagtaaacgttttctctggcccgcttctgacctccacagacaacagacaacttaataaaggaagatttatggcatagttcatggtggctgatagccacttttggtgtgttctgagtcatgttgcccagggagctttgaataagtggggagttgggacttagagacggccctcactgagcgtctgaggttttaacttgtcggttgcttgacctggatgaggtcttcctcacctgagtccaacacatgaacgttggttggcaacagtgccctcctgccc

SEQ ID NO: 308799 - DNA, 3435 bp, Homo sapiens
taaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaataaagcagtcaaaaagaagtcctccatgttggtgccaaggacttgcgaggggaaataaaaatgttatccagcctgaccaacatggagaaaccccgtctccattaaaaatacaaaattagcctggcatggtggcgcatgcctgtaatcccagctactctggaggctgaggcaggagaatcgcttgaacccaggaggcggaggtcgcagtgagccgagatcatgccagtgcactccagcctgggtaacaagagtgaaactccgtgtccaaaaaaaaaaaaaaaaatgttactcatcctctctgaaagcaaaaaggaaaccctaacagctctgaactctggttttatttttcttgctgtatttgggtgaacattgtatgattaggcataatgttaaaaaaaaaaatttttttttggtagaaatgcaatcaccagtaaagaggtacgaaaaagctagcctctctcagagaccggggaggcagagtactactagaggaagtgaagttctgatggaatcatgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtataaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactcta

SEQ ID NO: 308800 - DNA, 1064 bp, Homo sapiens
tcactaaatgatgccaaataaaagagtatattttatctacatcttaagtgggtaacatttatgcagtttaaatgaatggaatattttcctcttgtatagttgtatctgtttgtatttttctttgatgaatgattggtcatgaggcctcttgccacactccagaaatacgtgtgcggctgcttttaagaactatgtgtctggtcacttatttctctaaaattatctcattgcctgtcaaatgaggtcttgaagcggatgcccaaataaaagagtatattttatctaaatcttaagtgggtaacattttatgcagtttaaatgaatggaatattttcctcttgtttagttgtatctgtttgtatttttctttgatgaatgattggtcatgaggcctcttgccacactccagaaatacgtgtgcggctgcttttaagaactatgtgtctggtcacttatttctctaaaattatctcattgcctggcaatcagtcttctcttgtatacttgtcctagcacattatgtacatgggaaatgtaaacaaatgtgaaggaggaccagaaaaattagttaatatttaaaaaaatgtattgtgcattttggcttcacatgtttaactttttttaagaaaaaagttgcatgaatggaaaaaaaaatctgtatacagtatctgtaaaaactatcttatctgtttcaattccttgctcatatcccatataatctagaactaaatatggtgtgtggccatatttaaacacctgagagtcaagcagttgagactttgatttgaagcacctcatccttctttcaatgcgaacactatcatatggcattcttactgaggattttgtctaaccatatgttgccatgaattaactctgccgcctttcttaaggatcaaaaccagtttgatttgggaatcttcccctttccaaatgaaatagagatgcagtacttaactttccttggtgtttgtagatattgccttgtgtattccacttaaaaccgtaatctagtttgtaaaagagatggtgacgcatgtaaataaagcatcagtgacactcta

SEQ ID NO: 308801 - DNA, 2316 bp, Homo sapiens
taaaaagcattaggcatataaatgtataaatatattttatcatgtacagtacaaaaatggaaccttatgcatgggccttaggaatacaggctagtatttcagcacagacttccctgcttgagttcttgctgatgcttgcaccgtgacagtgggcaccaacacagacgtgccacccaaccccctgcacacaccaccggccaccaggggcccccttgtgcgccttggctttataactcctctgggggtgatattggtggtgatcacagctcctagcataatgagagttccatttggtattgtcacacgtctcctgcctcgcttgggttgccatgtttgagcgatggccctgttgatttcaccctgccttttactgaatctgtaaattgttgtgcaattgtggttatagtagactgtagcacattgccttttctaaactgctacatgtttataatcttcatttttaaagtatgtgtaatttttttaagtatgtattctattcatatggtctgcttgtcagtgagccagacttgcttactatattcctttataataatgctagccacttcctggattctttagtaatgtgctgtatgcaagaactttccagtagcagtgaaggagggttgcctctccaagcttcctaagggatgctgccctgtgtggggatgcattgcagaggcactagtagcatgggggctagagtggggagcgagatgtaaaagggtggggggataggagaattccagagtgcttccagcattagggtcctgagaacttctgagttcagagaaacatgcaaagtgactaacaaaatagctacttacctttgcagttttacagaccctgggagctgctttgggagtgagaaaggcaaccctccaatgtgtttcaactttaaaatgttgaattcttttcagacatggtatctcatttattctccttttctagcgtttgttgaatttcaggcagaatgtcttacagaatgtcctagaaccagattatcatttaatctgaaacagctgaggaagggacagagaaggtacaagggcaaggcagcacaaaacagatcaggagaatgaagagggaatgctttggttttttgttttgttttgttttttctttttcaagtaactaaaacagcatctacatgtagagtgttgtggagagctgagaccagggtaaagtcaagtgcagcatcagtactgcgagacccaccagcccctggagagggtcagccgagaatctggtagtgaagcctgtctagggtcccggcaccctcaccctcagccacctgcagagaggccagggccccagagactagcctggttctgaagtgggcaggggtgctgccagagccctctgccccttatgttgagaccctgctttcaggacaggccagccgttggccaccatgtcacattctgagtgagtgtcacaggtccctaacaataattttctgatctggagcatatcagcagaatgcttagcctcaaggggcctggcagctgtaatgtttgatttatgatgagaactatccgaggccacccttggcctctaaataagctgctctagggagccgcctactttttgatgagaaattagaagagtacctaatgttgaaaacatgacatgcgctcttgggatctgctgttctctccagggctccagaacctgatacctgttaccaaagctaggaaagagctttatcacaagccttcactgtcctggcatgagaactggctgccaggctcagtgtaccccattaactgtgaatgaatctgagcttggtttcctttattgcttcctctgcaatatgattgctgaaacacattttaaaaattcagaagcttgtcactcctgttaatgggaggatcagtcacacatgtgtagtacaaggcggactttgtgtttgtttttggtgttaatttttagcattgtgtgtgttgcttccccaccctgaggagaggacaccatggcttactactcaggacaagtatgccccgctcagggtgtgatttcaggtggcttccaaacttgtacgcagtttaaagatggtggggacagactttgcctctacctagtgaaccccacttaaagaataaggagcatttgaatctcttggaaaaggccatgaagaacgtcacagcatgattgacagtagtttatcagaaaattgcattagcagccatagctgcctttatgtctggtgtgatcctcacagctgtggctgttattacagtccagcttagaagacaatacgtcaggaaatatgacgagaagctgaggaacgaaagaaacttcgacaagagaatggcg

SEQ ID NO: 308802 - DNA, 1124 bp, Homo sapiens
tttttctgagacagagtctcaccctgttgcccaggctggagtgcagtgacagcgatcttggctcactgcaagctccgcctcccgggttcacgccattcttctgcctcagcctcctgagcagctatgactacaggtgcccaccaccatgcctggctaatttttttatatttttattagagacagggtttcaccatgttagccaggttggtcttgatctcctgaccttgtgatccgcccgccttggcctcccaaagtgctgggattacaggccaccgtacccggccaggctatttttttgttttgtttttgtttactactgtattgcttttctctttttcatatttattgagcacctactatatgccagtcaccatgctagatgctttagtaacatgaaggtttcaaactaagaaaagctcaacaaagagccctttagaaaggtaacagttttcctgtgtattgggggagtgggtctcataaggttgtatgatgagaagcgcaagtaattgttttgttttttttttgagacaatgtcttgctctgtcgatcaggctggagtgcagtggcgtcatctcagctcgctacaacctccacctcctgggtttaagtgattctctggcctcagcctcctgagtagctgagattacaggcacgcgccaccacgcccggctaatttttgtatttttagtagagacagggtttcactatgttggtcaggctgatcttgaactcccggcctcaggtgatctgcctgccttggcctcccaaactgctgggattacaggcatgagccaccacgcccagcctggctaaggttcattatccccatctttcagatgaggaggcacacaactctccccagatcccacgtcacagagaatgcaggtctgagtctgttccttgagctcagggtcttggcaatggtgatgctttggagctgcagaatcctctgttggggatggggctgccctgtgcattatagtacgtttagcaacatccctagcttccacctactaaatgccactagcactccttcagatgagaccatcgttgcaacgatggtcctcagcttctattatgtcagaagatacttctaatcactctgcattccttgtctcatttgt

SEQ ID NO: 308803 - DNA, 919 bp, Homo sapiens
tttttctgagacagagtctcaccctgttgcccaggctggagtgcagtgacagcgatcttggctcactgcaagctccgcctcccgggttcacgccattcttctgcctcagcctcctgagcagctatgactacaggtgcccaccaccatgcctggctaatttttttatatttttattagagacagggtttcaccatgttagccaggttggtcttgatctcctgaccttgtgatccgcccgccttggcctcccaaagtgctgggattacaggccaccgtacccggccaggctatttttttgttttgtttttgtttactactgtattgcttttctctttttcatatttattgagcacctactatatgccagtcaccatgctagatgctttagtaacatgaaggtttcaaactaagaaaagctcaacaaagagccctttagaaaggtaacagttttcctgtgtattgggggagtgggtctcataaggttgtatgatgagaagcgcaagtaattgttttgttttttttttgagacaatgtcttgctctgtcgatcaggctggagtgcagtggcgtcatctcagctcgctacaacctccacctcctgggtttaagtgattctctggcctcagcctcctgagtagctgagattacaggcattagctaccacacctggccaaggcccaggtttcgacagaaagggagagaaaacctgccagagatgccatttcggagccactctgcttggcagggacctgtgttcccctcatgcaggttcatccttagagggctgcggtcttatctggttgtgcaaaagtcccacaacctttctggattgatagtttgtggtgaaataaacaattttagtttgtttggagaatcttttgtatacaaaatacaaataaaacctaaatcaaagaaacaga

SEQ ID NO: 308804 - DNA, 1221 bp, Homo sapiens
aggggaaaagagcccatggtgtgcagaaaaccatgcgtcatgattcttatttcctgctcgcagctttgactctctgcctcatctcttcctggaagtgtcttggaagttaggcgactgcacagggaaaggttcgctgcagtgcttgcaggcctgcacccatttattcatccggtggatatttgctgggtgcccggcctggggatccatggtgagcgaggaaggcatggtattgaagtggtatgcctgcatgaccttggcgggggcgcatggcatagagaggacaggcttcagaacaggcaggcaagggctgaaatcctatctctgccaccgaacagctaatgaccccagcaagcaatttcacatccccgaactttcctgtttcctcatgtgtcaaatggggatgatctcgagacgactctccagagtaaccacgtgaagcacctagcacaggggctgacgcaaacagctgggcatcggaggagcctccagggttgtgacctccagtggcttattttccttttgggatcttctctcctagatcctcccctttaattccctgtgaaatttaccactttcatattgaatcgttggcacacagggctaactgcttgttcacctgaaggaagctacagagttcaggtttcttttttctttctttctttcttttttgcttttttaagatgatcttgctccgtcacccaggctggagtgcagtggcgtaatcatggcttcctgcagcctcaaactcctgggctcaatgagttccttgagatcttccatcctcagcttcccaagtagctagtagtagtagtggcttgcaccaacgctcctgccctaattttcaatatttttttgtagagataggatctcactgtgttacccaagctagacttgaactcctggcctcaagcgatccttccgccttggcctcccaaagtgttgggattacaggcattagctaccacacctggccaaggcccaggtttcgacagaaagggagagaaaacctgccagagatgccatttcggagccactctgcttggcagggacctgtgttcccctcatgcaggttcatccttagagggctgcggtcttatctggttgtgcaaaagtcccacaacctttctggattgatagtttgtggtgaaataaacaattttagtttgtttggagaatcttttgtatacaaaatacaaataaaacctaaatcaaagaaacaga

SEQ ID NO: 308805 - DNA, 1236 bp, Homo sapiens
tttttctgagacagagtctcaccctgttgcccaggctggagtgcagtgacagcgatcttggctcactgcaagctccgcctcccgggttcacgccattcttctgcctcagcctcctgagcagctatgactacaggtgcccaccaccatgcctggctaatttttttatatttttattagagacagggtttcaccatgttagccaggttggtcttgatctcctgaccttgtgatccgcccgccttggcctcccaaagtgctgggattacaggccaccgtacccggccaggctatttttttgttttgtttttgtttactactgtattgcttttctctttttcatatttattgagcacctactatatgccagtcaccatgctagatgctttagtaacatgaaggtttcaaactaagaaaagctcaacaaagagccctttagaaaggtaacagttttcctgtgtattgggggagtgggtctcataaggttgtatgatgagaagcgcaagtaattgttttgttttttttttgagacaatgtcttgctctgtcgatcaggctggagtgcagtggcgtcatctcagctcgctacaacctccacctcctgggtttaagtgattctctggcctcagcctcctgagtagctgagattacaggcacgcgccaccacgcccggctaatttttgtatttttagtagagacagggtttcactatgttggtcaggctgatcttgaactcccggcctcaggtgatctgcctgccttggcctcccaaactgctgggattacaggcatgagccaccacgcccagcctggctaaggttcattatccccatctttcagatgaggaggcacacaactctccccagatcccacgtcacagagaatgcaggtctgagtctgttccttgagctcagggtcttggcaatggtgatgctttggagctgcagaatcctctgttggggatggggctgccctgtgcattatagtacgtttagcaacatccctagcttccacctactaaatgccactagcactccttcagatgagaccaccaaaaatgtctccagatgttaccacatgtcccctgggggggtaaaagtgccccggtggagagcactggctcttttcttcacagtcctgacctggtggcctgcacaggccacttctccgaagtgtttcaatgcactctctgccctgggtaccttggacacagcaccctggcccagagaggttggctgac

SEQ ID NO: 308806 - DNA, 649 bp, Homo sapiens
aggggaaaagagcccatggtgtgcagaaaaccatgcgtcatgattcttatttcctgctcgcagctttgactctctgcctcatctcttcctggaagtgtcttggaagttaggcgactgcacagggaaaggttcgctgcagtgcttgcaggcctgcacccatttattcatccggtggatatttgctgggtgcccggcctggggatccatggtgagcgaggaaggcatggtattgaagtggtatgcctgcatgaccttggcgggggcgcatggcatagagaggacaggcttcagaacaggcaggcaagggctgaaatcctatctctgccaccgaacaagctagactccatctcaaaaacaaacaaacaaaaaaacaaaagcaaaaaccagtcttagctcacaggctgtgccaaaacaggcagtgggctggatttggtcctcaagcctgggcttgctgacctctggcctaggacacctctcctttatgcctccgctcccaacacggactctcaactctcatgtttaccttgtcattgttctgtcaagaggaattcactagtctcactcctccaaccagaccgctgccactaaggcttcttctgaacagaaattctggatttgttctcacccatttcataaatgtacataagca

SEQ ID NO: 308807 - DNA, 3125 bp, Homo sapiens
aaagtgggaagcgtgaaggagggaccctgaggtagagggtcaggggttagtgaggccggaagtgagtgtaataaagtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttcta

SEQ ID NO: 308808 - DNA, 774 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggaccgggttccacatgggcggacagggtggggaggccccagccaggtcccggcgtcaccgcgtcggtccgggcccaccggggtgggcc

SEQ ID NO: 308809 - DNA, 7174 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308810 - DNA, 6822 bp, Homo sapiens
aaagtgggaagcgtgaaggagggaccctgaggtagagggtcaggggttagtgaggccggaagtgagtgtaataaagtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308811 - DNA, 7120 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacaggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308812 - DNA, 7038 bp, Homo sapiens
aaagtgggaagcgtgaaggagggaccctgaggtagagggtcaggggttagtgaggccggaagtgagtgtaataaagtttctccagggaggcagggcccggggagaaagttggagcggtaacctaagctggcagtggcgtgatccggcaccaaatcggcccgcggtgcggtgcggagactccatgaggccctgacggagtttcgctcttatcgtccaggctggagtgcaatggtgcgatctcggctcactgcaacctccgcctcctgagttcaagtgattctcctgcctcagcctcctgagtagctgggattacaggcgcccaccaccacgcccggctaatttttgtatttttagtagagacggggtttccccatgttggctaggctagcctcgaactcctgacctcaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308813 - DNA, 7611 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtgagatggggtttcgccatgttgcccaagctgttcttgaactcccgggctcaagtgatccgcctccctcggcctcccagagtgctgggattacaggcacggaccaccatgcccagcctccacatctttttttgcactgtgtatactcttctgagacatgccaacttcctccaggtcaagaaaggggtatatagctctcagcttcactctttcagggctgatgtcgcctttgccttttctcacttcactgacctgtctattcctacaactgtctctttctagagaagcctcaatgatcaggattgacaggccacactctcccccaccatttttttctcctccttcaagcctcttgtctgtttcaccctcttccaccttggaggctgaggtcttatttgactcttcacctgaattgaccttcttccttcccaccctcccaggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308814 - DNA, 6692 bp, Homo sapiens
tgggctctcgggcctgtgttgtgaccgagctacgcgcgtagccaagtcgcatgcgcgctggactttagccatccgagttgcagcgcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308815 - DNA, 7154 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308816 - DNA, 6575 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308817 - DNA, 6468 bp, Homo sapiens
cagccttttacccttctctggctttcccctctccccactgtcctcacagatcacagcctcaaactgaaggtgtctggcttcataactagcaccacctccaatctctgcctgtggaaagtcccctgccatctttcgaggtccagctcaaacgcgacctcctctggcaggccttctttgatgtccagcccacgtctttcttttcttccgaacgcccacacccgttggtccttccctggctctggatactgtaggctcccacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308818 - DNA, 6768 bp, Homo sapiens
aaagtgggaagcgtgaaggagggaccctgaggtagagggtcaggggttagtgaggccggaagtgagtgtaataaagtttctccagggaggcagggcccggggagaaagttggagcggtaacctaagctggcagtggcgtgatccggcaccaaatcggcccgcggtgcggtgcggagactccatgaggccctggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacaggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308819 - DNA, 6186 bp, Homo sapiens
cccactgcaatctattttttgcgtcttttttttatcggcacagccgttttgtcgccttgttgccaaacccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308820 - DNA, 3665 bp, Homo sapiens
  misc_feature (3508)..(3508): n is a, c, g, or t
  misc_feature (3513)..(3513): n is a, c, g, or t
  misc_feature (3515)..(3515): n is a, c, g, or t
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctaaaaaaaaaaaaaaaaacaaaaaaaaaaaaanaaaananaaaaaaaaaaaaaaaaaaagggcggccgccgcggggccccggcggcgggggcacggtcccccgcgaggggggcccgggcacctggggggccggcggcggcggcgactctggacgcgagccgggcccttcccgtggatcgccccagctgcg

SEQ ID NO: 308821 - DNA, 5607 bp, Homo sapiens
tgtattggtggtgctctccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308822 - DNA, 2029 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtgggtgagtgtggcagaggtgtgggtgaggggtggcaaaaaggaaggtacagtaccctacagtgtatccctcttccttccctcattgctttgtagacattcccgctgggcagctgtctatgggcctctcttgctctttaaagtgtctggcatcttcctccagaggctcatcccttagcctgaactatg

SEQ ID NO: 308823 - DNA, 322 bp, Homo sapiens
  misc_feature (48)..(48): n is a, c, g, or t
atcgatcgtgatcagcactgacccgacctcagagagtactcgcagggngcctggctgactcaagaccctcgagattaacggtgctaacctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308824 - DNA, 456 bp, Homo sapiens
gtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcgggtgagtgaacatcctcctctccattcccccgcagaccccctccagttctaatgctcactccagcttggccggaatctcttttttcctgctgttccccaacaaccccgtttcagtgtcctatttcctaaacctttctcatcccttccccgattctgtagccccttcccttccagctttgcctgggcccccttccttcttttcactcccccacccccaccctggcatgcttagcacaatgcccag

SEQ ID NO: 308825 - DNA, 351 bp, Homo sapiens
ctttggtcatctgtacccactctaagtagatctcagtgggggttcctgcagaggaagatgagggcccctgtctgtgcctcctcccagtgggctcagctcactgacagcctctgctgtgccctcagcctgccacattctggagtgtcccgaagggcttgcccaggatgtcatcagcaccattggccaggccttcgagttgcgcttcaaacaatacctcaggaacccacccaaactggtcacccctcatgacaggtgagcaggtggggagagtgtggagcagctcttggattaggattaggaaaggagggctgctcttcctacacttgagttgagaggttcagggagggaata

SEQ ID NO: 308826 - DNA, 3686 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctaaaaaaaaaaaaaaaaaaatacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcc

SEQ ID NO: 308827 - DNA, 2222 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgttcatgtcctggaggaggggcagccatgccagactcaggccccctacccctcccctgagctgcctacggaggcgccccctggggacgcccttgccgatcccccgtcgggcaccactgaggaggaggaagagcagcctgggaaggccccggacccgcaggacccccaggacgcggagtccgactctgccaccggatcgcagaggcagtccgtcatccagcagcctgccccggacaggggcacggcgaaactgggaaccaagaggccgcaccccgaggatggggacgggcagagcctcgagggcgtctctagctccggcgacagcgcagggctggaggccgggcagggccctggggctgacgagccgggcttgtcccgcgggaagccctatgcctgcggcgagtgcggggaggccttcgcgtggctctcgcacctgatggagcaccacagcagccatggcggccggaagcgctacgcctgtcagggctgctggaagaccttccacttcagcctggccctagccgagcaccagaagacccacgagaaggagaaaagctacgcgctggggggcgcccggggcccccaaccgtccacccgcgaagcccaggcgggggctagggcgggcggtcccccagagagcgtggagggcgaggctccccccgcacccccagaggcgcagaggtgagccgctgtgctgtcccgttccggaggggccgctttgccggccgtgaatcccagacgaggcattgggcctttccacgcccctgggtggcggcttcctgtggtgtttgtggacgtcctctgcctgtgccctgaatccgctcctgaggctaagcgctcccaacgagaagggtccacgggaagccctcacctctgtaaacacaccctgggccagcgctcgcatccgaggggagccgccggatgtggaagaagactcggctttcctgcagccatttagtgccgccccatgctaggttatttgacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagatctgtctgtctgagc

SEQ ID NO: 308828 - DNA, 7034 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgtccactactttttggaacaaagtgatggcagaatgcggtggtggtgggggtcttttgtactgttggattaataaaatgattttaaaatcccaga

SEQ ID NO: 308829 - DNA, 6432 bp, Homo sapiens
aggcaggcaggcgctgggtctgagtacccctctttccccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308830 - DNA, 6892 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308831 - DNA, 3895 bp, Homo sapiens
  misc_feature (3508)..(3508): n is a, c, g, or t
  misc_feature (3513)..(3513): n is a, c, g, or t
  misc_feature (3515)..(3515): n is a, c, g, or t
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctaaaaaaaaaaaaaaaaacaaaaaaaaaaaaanaaaananaaaaaaaaaaaaaaaaaaacaaaaacaaaaaaaaaacaaaaaacacacaaacaaaaaagaaaagacaacaaaacaaaaaaaacaaaaaaaaaaaaaagaggggggggggcccacacaaaacctgacaggcgtacgcgcacagcaccgagagacgagccccacagatatgaagaaaagagggacgccaggaggggggggagatagcacacaggaagagagagagggagagagacgccaaaaacggaggaggaggggcagcacaaaagcgagagagcagacgagaaaggagaaagcgaagcccacaacaggggggggagaagcagcgcaagggcgacacagtacaacgacacgagcgagaagaagacagaggcgagaacaga

SEQ ID NO: 308832 - DNA, 6080 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtaagcctcgtccctcgcccgccgcctgttttcaggcgtagcgtctcgtccggtccttgctccccctccccgcagcgctcagtggtggtggccgcgacgagttccggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatcccaga

SEQ ID NO: 308833 - DNA, 2955 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattgcctgtaggacagcctgttgggggagatccagaagtccgcaaacagatgccacctccaccaccctgtccagcaggcagagagctttttgatgatccctcctatgtcaacgtccagaacctagacaaggcccggcaagcagtgggtggtgctgggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagagggtttgagtcaaaagcctgggtgagaatcctgcctctccccaaacattaatcaccaaagtattaatgtacagagtggcccctcacctgggcctttcctgtgccaacctgatgccccttccccaagaaggtgagtgcttgtcatggaaaatgtcctgtggtgacaggcccagtggaacagtcacccttctgggcaagggggaacaaatcacacctctgggcttcagggtatcccagacccctctcaacacccgccccccccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactcttgcaatatattttataaaattataaaaaatcattcttactataaatcattacacaattcccatattctatctatatatttctaactatatgcttttttctgtccccg

SEQ ID NO: 308834 - DNA, 1486 bp, Homo sapiens
aagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatccactccggaatgagtctctgtcatcgctggaggaaggggcttctgggtccacccccccggaggagctgccttccccatcagcttcatccctggggcccatcctgcctcctctgcctggggacgatagtcccactaccctgtgctccttcttcccccggatgagcaacctgaggctggccaacccggctggggggcgcccagggtctaagggggagccaggaagggcagctgatgatggggaggggatcgtaggggcagccatgccagactcaggccccctacccctcctccaggacatgaacaagctgagtggaggcggcgggcgcaggactcgggtggaagggggccagcttgggggcgaggagtggacccgccacgggagctttgtcaataagcccacgcggggctggctgcatcccaacgacaaagtcatgggacccggggtttcctacttggttcggtacatgggttgtgtggaggtcctccagtcaatgcgtgccctggacttcaacacccggactcaggtcaccagggaggccatcagtctggtgtgtgaggctgtgccgggtgctaagggggcgacaaggaggagaaagccctgtagccgcccgctcagctctatcctggggaggagtaacctgaaatttgctggaatgccaatcactctcaccgtctccaccagcagcctcaacctcatggccgcagactgcaaacagatcatcgccaaccaccacatgcaatctatctcatttgcatccggcggggatccggacacagccgagtatgtcgcctatgttgccaaagaccctgtgaatcagagagcctgccacattctggagtgtcccgaagggcttgcccaggatgtcatcagcaccattggccaggccttcgagttgcgcttcaaacaatacctcaggaacccacccaaactggtcacccctcatgacaggatggctggctttgatggctcagcatgggatgaggaggaggaagagccacctgaccatcagtactataatgacttcccggggaaggaaccccccttggggggggtggtagacatgaggcttcgggaaggagccgctccaggggctgctcgacccactgcacccaatgcccagacccccagccacttgggagctacattggcctgtaggacagcctcctcggggagatccagaagtgcgcgatactccgccgcagccctgagcaatacaatcttcctagtaacggcg

SEQ ID NO: 308835 - DNA, 2670 bp, Homo sapiens
cgggagacggaagtcttggccctgctccgctcccccgagaatcgggcctcgccctgctgggcggctggacctgggcaaagcctgggcgcgctcccgcgcagcggcgccatgaagcgctcggggactctgcggctgctctcggacctgagcgccttcggcggcgcggcgcggctccgggagctggtggccggggactcagcggtccgagtccgtggcagtccggacggccgccacttgctgctcctgcgaccccctggggcggtagccccacagctgctagtcgcgtcgcgagggcccggcgcggagctagagcgggcctggccggccggccagccctccccgctggacgccttcttcctgccgtggccagcgcggccggcgctggtgctggtgtgggagagtggcctggccgaggtgtggggcgcgggcgtggggcctggctggcggccgctgcagagcaccgagctgtgtccgggcgggggagcccgcgttgtggcagtggcggcgctccgaggccgcctggtgtggtgcgaggagcggcaggcccgggccgagggcccgtcagggtcgccagcagccgctttcagccactgtgtgtgcgtccggactctggagcccagcggggaagctagcaccagcctgggccgcacacacgtcctgctgcaccactgccctgccttcgggctgctggcctcctgcagacaactcttcctggtgcccactgccaccacctggcctggcgtggcccacgttctactcatctggagcccaggcaagggcaaagtgatggtggctgccccacggcttggtctctcctacagtaagagtctgaatcctggacgaggggacacatgggacttccggaccctgctccgaggccttcctgggttgctgtcccccagggagccactggctgtacacacctgggccccaactccccagggcctgctgttgcttgacttcgggggcactgtgagcctattgcagtcccacggtggtacgcgggctgtgggcaccctgcaggaggcacctgtaggcccgtgggggtctgcagccctaggcacatttcagggcactctggcctgtgtgctgggctccacattggaactgctggacatgggcagtgggcagctgctggagaggaaggtcctaagtacagacagggtacatctgctagaaccgccagcccccggcatggaggatgaggaagagctggagacccgagggaatcttcgtctgctttcagccttgggtctgttttgtgtgggctgggaagccccacagggtgttgagttgccttcagccaaggatctggtgtttgaggaggcctgcgggtactaccagcggcggagcctgcggggtgcccagctcactccagaagaactgagacacagcagcacattccgggcacctcaggctctggcctccatcctccagggccacctgcccccatctgcactgctgaccatgttgaggaccgagcttcgggattaccgaggcttagaacagctgaaggcccagctggtggctggggatgatgaggaggctggttggactgagctggcggagcaggaagtggcacgcctgctgaggactgagttgataggagaccagctagcccagctcaacaccgttttccaagcccttcctacagcagcctggggtgccaccctcagggccctgcagctccagctagatgggaatggcaagctgaggtcccaagcaccccctgatgtgtggaagaaagtgttagggggaataaccgctggaaaggaaccccccaatggaatactgcccccctttgaactcctgtgccagtgtctgtgccagctggagcctcgatggctgccaccctttgtggagctggcacagcagcagggcgggccgggctggggggcagggggcccaggactgcccctgtatcgccgagctctggcagtgctaggtgaggaggggaccaggcctgaggctctggagctagagctgctcttgagcagtgggcggcctaaagctgtgctccaagctgtcgggcagctggtgcaaaaggaacaatgggatcgggctctggatgctggcctggccctcggcccctccagtcccctgcttcgaagtgaaatcttcaaactgctgctggccgagtttgcccagcaccgccggcttgatgctcacctccccctcctttgccgcctgtgcccaccagaactggctccagctgagctcctgcttctactgaggacatacctcccagatgaggtggggcccccaaccccattccctgagcctggagcagagccccctctcactgtgggcttgctcaaagccctgctggagcagactggggctcaaggatggctgtcgggcccagttctaagcccatatgaggacatcctatgggaccccagcactccacccccgactccacctcgggacctatgactacccttcaggcatcagaacactcagggcctggaggcttgcttgggactggaggcttgcttggacagttcctctgtgtcactgacacaggaaatcatttctaggacacagtgatcagggaagggtgcctgggacttggagggtcccatgtatggacctgtgtatgcaatactgttctgtcatctggagctatttttaagatgtgtgtgttaaatatatacatagtttaatata

SEQ ID NO: 308836 - DNA, 2514 bp, Homo sapiens
cgggagacggaagtcttggccctgctccgctcccccgagaatcgggcctcgccctgctgggcggctggacctgggcaaagcctgggcgcgctcccgcgcagcggcgccatgaagcgctcggggactctgcggctgctctcggacctgagcgccttcggcggcgcggcgcggctccgggagctggtggccggggactcagcggtccgagtccgtggcagtccggacggccgccacttgctgctcctgcgaccccctggggcggtagccccacagctgctagtcgcgtcgcgagggcccggcgcggagctagagcgggcctggccggccggccagccctccccgctggacgccttcttcctgccgtggccagcgcggccggcgctggtgctggtgtgggagagtggcctggccgaggtgtggggcgcgggcgtggggcctggctggcggccgctgcagagcaccgagctgtgtccgggcgggggagcccgcgttgtggcagtggcggcgctccgaggccgcctggtgtggtgcgaggagcggcaggcccgggccgagggcccgtcagggtcgccagcagccgctttcagccactgtgtgtgcgtccggactctggagcccaagggcaaagtgatggtggctgccccacggcttggtctctcctacagtaagagtctgaatcctggacgaggggacacatgggacttccggaccctgctccgaggccttcctgggttgctgtcccccagggagccactggctgtacacacctgggccccaactccccagggcctgctgttgcttgacttcgggggcactgtgagcctattgcagtcccacggtggtacgcgggctgtgggcaccctgcaggaggcacctgtaggcccgtgggggtctgcagccctaggcacatttcagggcactctggcctgtgtgctgggctccacattggaactgctggacatgggcagtgggcagctgctggagaggaaggtcctaagtacagacagggtacatctgctagaaccgccagcccccggcatggaggatgaggaagagctggagacccgagggaatcttcgtctgctttcagccttgggtctgttttgtgtgggctgggaagccccacagggtgttgagttgccttcagccaaggatctggtgtttgaggaggcctgcgggtactaccagcggcggagcctgcggggtgcccagctcactccagaagaactgagacacagcagcacattccgggcacctcaggctctggcctccatcctccagggccacctgcccccatctgcactgctgaccatgttgaggaccgagcttcgggattaccgaggcttagaacagctgaaggcccagctggtggctggggatgatgaggaggctggttggactgagctggcggagcaggaagtggcacgcctgctgaggactgagttgataggagaccagctagcccagctcaacaccgttttccaagcccttcctacagcagcctggggtgccaccctcagggccctgcagctccagctagatgggaatggcaagctgaggtcccaagcaccccctgatgtgtggaagaaagtgttagggggaataaccgctggaaaggaaccccccaatggaatactgcccccctttgaactcctgtgccagtgtctgtgccagctggagcctcgatggctgccaccctttgtggagctggcacagcagcagggcgggccgggctggggggcagggggcccaggactgcccctgtatcgccgagctctggcagtgctaggtgaggaggggaccaggcctgaggctctggagctagagctgctcttgagcagtgggcggcctaaagctgtgctccaagctgtcgggcagctggtgcaaaaggaacaatgggatcgggctctggatgctggcctggccctcggcccctccagtcccctgcttcgaagtgaaatcttcaaactgctgctggccgagtttgcccagcaccgccggcttgatgctcacctccccctcctttgccgcctgtgcccaccagaactggctccagctgagctcctgcttctactgaggacatacctcccagatgaggtggggcccccaaccccattccctgagcctggagcagagccccctctcactgtgggcttgctcaaagccctgctggagcagactggggctcaaggatggctgtcgggcccagttctaagcccatatgaggacatcctatgggaccccagcactccacccccgactccacctcgggacctatgactacccttcaggcatcagaacactcagggcctggaggcttgcttgggactggaggcttgcttggacagttcctctgtgtcactgacacaggaaatcatttctaggacacagtgatcagggaagggtgcctgggacttggagggtcccatgtatggacctgtgtatgcaatactgttctgtcatctggagctatttttaagatgtgtgtgttaaatatatacatagtttaatata

SEQ ID NO: 308837 - DNA, 2616 bp, Homo sapiens
cgggagacggaagtcttggccctgctccgctcccccgagaatcgggcctcgccctgctgggcggctggacctgggcaaagcctgggcgcgctcccgcgcagcggcgccatgaagcgctcggggactctgcggctgctctcggacctgagcgccttcggcggcgcggcgcggctccgggagctggtggccggggactcagcggtccgagtccgtggcagtccggacggccgccacttgctgctcctgcgaccccctggggcggtagccccacagctgctagtcgcgtcgcgagggcccggcgcggagctagagcgggcctggccggccggccagccctccccgctggacgccttcttcctgccgtggccagcgcggccggcgctggtgctggtgtgggagagtggcctggccgaggtgtggggcgcgggcgtggggcctggctggcggccgctgcagagcaccgagctgtgtccgggcgggggagcccgcgttgtggcagtggcggcgctccgaggccgcctggtgtggtgcgaggagcggcaggcccgggccgagggcccgtcagggtcgccagcagccgctttcagccactgtgtgtgcgtccggactctggagcccagcggggaagctagcaccagcctgggccgcacacacgtcctgctgcaccactgccctgccttcgggctgctggcctcctgcagacaactcttcctggtgcccactgccaccacctggcctggcgtggcccacgttctactcatctggagcccaggcaagggcaaagtgatggtggctgccccacggcttggtctctcctacagtaagagtctgaatcctggacgaggggacacatgggacttccggaccctgctccgaggccttcctgggttgctgtcccccagggagccactggctgtacacacctgggccccaactccccagggcctgctgttgcttgacttcgggggcactgtgagcctattgcagtcccacggtggtacgcgggctgtgggcaccctgcaggaggcacctgtaggcccgtgggggtctgcagccctaggcacatttcagggcactctggcctgtgtgctgggctccacattggaactgctggacatgggcagtgggcagctgctggagaggaaggtcctaagtacagacagggtacatctgctagaaccgccagcccccggcatggaggatgaggaagagctggagacccgagggaatcttcgtctgctttcagccttgggtctgttttgtgtgggctgggaagccccacagggtgttgagttgccttcagccaaggatctggtgtttgaggaggcctgcgggtactaccagcggcggagcctgcggggtgcccagctcactccagaagaactgagacacagcagcacattccgggcacctcaggctctggcctccatcctccagggccacctgcccccatctgcactgctgaccatgttgaggaccgagcttcgggattaccgaggcttagaacagctgaaggcccagctggtggctggggatgatgaggaggctggttggactgagctggcggagcaggaagtggcacgcctgctgaggactgagttgataggagaccagctagcccagctcaacaccgttttccaagcccttcctacagcagcctggggtgccaccctcagggccctgcagctccagctagatgggaatggcaagctgaggtcccaagcaccccctgatgtgtggaagaaagtgttagggggaataaccgctggaaaggaaccccccaatggaatactgcccccctttgaactcctgtgccagtgtctgtgccagctggagcctcgatggctgccaccctttgtggagctggcacagcagcagggcgggccgggctggggggcagggggcccaggactgcccctgtatcgccgagctctggcagtgctaggtgaggaggggaccaggcctgaggctctggagctagagctgctcttgagcagtgggcggcctaaagctgtgctccaagctgtcgggcagctggtgcatcccctgcttcgaagtgaaatcttcaaactgctgctggccgagtttgcccagcaccgccggcttgatgctcacctccccctcctttgccgcctgtgcccaccagaactggctccagctgagctcctgcttctactgaggacatacctcccagatgaggtggggcccccaaccccattccctgagcctggagcagagccccctctcactgtgggcttgctcaaagccctgctggagcagactggggctcaaggatggctgtcgggcccagttctaagcccatatgaggacatcctatgggaccccagcactccacccccgactccacctcgggacctatgactacccttcaggcatcagaacactcagggcctggaggcttgcttgggactggaggcttgcttggacagttcctctgtgtcactgacacaggaaatcatttctaggacacagtgatcagggaagggtgcctgggacttggagggtcccatgtatggacctgtgtatgcaatactgttctgtcatctggagctatttttaagatgtgtgtgttaaatatatacatagtttaatata

SEQ ID NO: 308838 - DNA, 2921 bp, Homo sapiens
cgggagacggaagtcttggccctgctccgctcccccgagaatcgggcctcgccctgctgggcggctggacctgggcaaagcctgggcgcgctcccgcgcagcggcgccatgaagcgctcggggactctgcggctgctctcggacctgagcgccttcggcggcgcggcgcggctccgggagctggtggccggggactcagcggtccgagtccgtggcagtccggacggccgccacttgctgctcctgcgaccccctggggcggtagccccacagctgctagtcgcgtcgcgagggcccggcgcggagctagagcgggcctggccggccggccagccctccccgctggacgccttcttcctgccgtggccagcgcggccggcgctggtgctggtgtgggagagtggcctggccgaggtgtggggcgcgggcgtggggcctggctggcggccgctgcagagcaccgagctgtgtccgggcgggggagcccgcgttgtggcagtggcggcgctccgaggccgcctggtgtggtgcgaggagcggcaggcccgggccgagggcccgtcagggtcgccagcagccgctttcagccactgtgtgtgcgtccggactctggagcccagcggggaagctagcaccagcctgggccgcacacacgtcctgctgcaccactgccctgccttcgggctgctggcctcctgcagacaactcttcctggtgcccactgccaccacctggcctggcgtggcccacgttctactcatctggagcccaggcaagggcaaagtgatggtggctgccccacggcttggtctctcctacagtaagagtctgaatcctggacgaggggacacatgggacttccggaccctgctccgaggccttcctgggttgctgtcccccagggagccactggctgtacacacctgggccccaactccccagggcctgctgttgcttgacttcgggggcactgtgagcctattgcagtcccacggtggtacgcgggctgtgggcaccctgcaggaggcacctgtaggcccgtgggggtctgcagccctaggcacatttcagggcactctggcctgtgtgctgggctccacattggaactgctggacatgggcagtgggcagctgctggagaggaaggtcctaagtacagacagggtacatctgctagaaccgccagcccccggcatggaggatgaggaagagctggagacccgagggaatcttcgtctgctttcagccttgggtctgttttgtgtgggctgggaagccccacagggtgttgagttgccttcagccaaggatctggtgtttgaggaggcctgcgggtactaccagcggcggagcctgcggggtgcccagctcactccagaagaactgagacacagcagcacattccgggcacctcaggctctggcctccatcctccagggccacctgcccccatctgcactgctgaccatgttgaggaccgagcttcgggattaccgaggcttagaacagctgaaggcccagctggtggctggggatgatgaggaggctggttggactgagctggcggagcaggaagtggcacgcctgctgaggactgagttgataggagaccagctagcccagctcaacaccgttttccaagcccttcctacagcagcctggggtgccaccctcagggccctgcagctccagctagatgggaatggcaagctgaggtcccaagcaccccctgatgtgtggaagaaagtgttagggggaataaccgctggaaaggaaccccccaatggaatactgcccccctttgaactcctgtgccagtgtctgtgccagctggagcctcgatggctgccaccctttgtggagctggcacagcagcagggcgggccgggctggggggcagggggcccaggactgcccctgtatcgccgagctctggcagtgctaggtgaggaggggaccaggcctgaggctctggagctagagctgctcttgagcagtgggcggcctaaagctgtgctccaagctgtcgggcagctggtgcaaaaggaacaatgggatcgggctctggatgctggcctggccctcggcccctccagtcccctgcttcgaagtgaaatcttcaaactgctgctggccgagtttgcccagcaccgccggcttgatgctcacctccccctcctttgccgcctgtgcccaccagaactggctccagctgagctcctgcttctactgaggacatacctcccagatgaggtggggcccccaaccccattccctgagcctggagcagagccccctctcactgtgggcttgctcaaagccctgctggagcagactggggctcaaggatggctgtcgggcccagttctaagcccatatgaggacatcctatgggaccccagcactccacccccgactccacctcgggacctatgactacccttcaggcatcagaacactcagggcctggaggcttgcttgggactggaggcttgcttggacagttcctctgtgtcactgacacaggaaatcatttctaggacacagtgatcagggaagggtgcctgggacttggagggtcccatgtatggacctgtgtatgcaatactgttctgtcatctggagctatttttaagatgtgtgtgttaaatatatacatagtttaatatatacacagttgtgtgtttttaaacaggtacaggtctcagaggatgcaggttatagagggagtggttggatctggatcttttggctaaagtccccacttccaatcatgaaaatagttaacatttatgagcatttaatagaagccaggcattctactcatctttatataatccctcagctagcttctcataaccccagtggggaaagtactgatgttattcccattttacaggaaatagaagtttagaaaaatt

SEQ ID NO: 308839 - DNA, 2334 bp, Homo sapiens
cgggagacggaagtcttggccctgctccgctcccccgagaatcgggcctcgccctgctgggcggctggacctgggcaaagcctgggcgcgctcccgcgcagcggcgccatgaagcgctcggggactctgcggctgctctcggacctgagcgccttcggcggcgcggcgcggctccgggagctggtggccggggactcagcggtccgagtccgtggcagtccggacggccgccacttgctgctcctgcgaccccctggggcggtagccccacagctgctagtcgcgtcgcgagggcccggcgcggagctagagcgggcctggccggccggccagccctccccgctggacgccttcttcctgccgtggccagcgcggccggcgctggtgctggtgtgggagagtggcctggccgaggtgtggggcgcgggcgtggggcctggctggcggccgctgcagagcaccgagctgtgtccgggcgggggagcccgcgttgtggcagtggcggcgctccgaggccgcctggtgtggtgcgaggagcggcaggcccgggccgagggcccgtcagggtcgccagcagccgctttcagccactgtgtgtgcgtccggactctggagcccagcggggaagctagcaccagcctgggccgcacacacgtcctgctgcaccactgccctgccttcgggctgctggcctcctgcagacaactcttcctggtgcccactgccaccacctggcctggcgtggcccacgttctactcatctggagcccaggcaagggcaaagtgatggtggctgccccacggcttggtctctcctacagtaagagtctgaatcctggacgaggggacacatgggacttccggaccctgctccgaggccttcctgggttgctgtcccccagggagccactggctgtacacacctgggccccaactccccagggcctgctgttgcttgacttcgggggcactgtgagcctattgcagtcccacggtggtacgcgggctgtgggcaccctgcaggaggcacctgtaggcccgtgggggtctgcagccctaggcacatttcagggcactctggcctgtgtgctgggctccacattggaactgctggacatgggcagtgggcagctgctggagaggaaggtcctaagtacagacagggtacatctgctagaaccgccagcccccggcatggaggatgaggaagagctggagacccgagggaatcttcgtctgctttcagccttgggtctgttttgtgtgggctgggaagccccacagggtgttgagttgccttcagccaaggatctggtgtttgaggaggcctgcgggtactaccagcggcggagcctgcggggtgcccagctcactccagaagaactgagacacagcagcacattccgggcacctcaggctctggcctccatcctccagggccacctgcccccatctgcactgctgaccatgttgaggaccgagcttcgggattaccgaggcttagaacagctgaaggcccagctggtggctggggatgatgaggaggctggttggactgagctggcggagcaggaagtggcacgcctgctgaggactgagttgataggagaccagctagcccagctcaacaccgttttccaagcccttcctacagcagcctggggtgccaccctcagggccctgcagctccagctagatgggaatggcaagctgaggtcccaagcaccccctgatgtgtggaagaaagtgttagggggaataaccgctggaaaggaaccccccaatggaatactgcccccctttgaactcctgtgccagtgtctgtgccagctggagcctcgatggctgccaccctttgtggagctggcacagcagcagggcgggccgggctggggggcagggggcccaggactgcccctgtatcgccgagctctggcagtgctaggtgaggaggggaccaggcctgaggctctggagctagagctgctcttgagcagtgggcggcctaaagctgtgctccaagctgtcgggcagctggtgcaaaaggaacaatgggatcgggctctggatgctggcctggccctcggcccctccagtcccctgcttcgaagtgaaatcttcaaactgctgctggccgagtttgcccagcaccgccggcttgatgctcacctccccctcctttgccgcctgtgcccaccagaactggctccagctgagctcctgcttctactgaggacatacggtcccatgtatggacctgtgtatgcaatactgttctgtcatctggagctatttttaagatgtgtgtgttaaatatatacatagtttaatata

SEQ ID NO: 308840 - DNA, 2550 bp, Homo sapiens
tctgttagaggagacatataaataagctcatctagggtcacctcattttcctaaatatgtttttaaagcaattattgtagtaatttcatttgagttaaatttacatgctcggtcactcattgagaaaatttacacagactctgaatccagttcctgtcatcttcagatgttggtttattgacatcacagtaaaaaggctactgtcgactggacacagtggctcacacatgtaatcacagcactttggggggccaaggtgggtggattgcttaagcccaggagttcaagaccagcctgggcaacatggctaaaccccatctctacaaaaaaaattagctgggtgtggtggtacatgcctgtggtcccagctactcggaaggctgaggtgggaggttcacttgaacctgggaggttgaggttgcagtgagcacagatcacaccactgcactccagcctgggcaacagagtgagaccctatttcaaaaaaaggctgctttcactgtactgctgcagcagtctcttcaggtagctaaattaggagcttgttttggagaaatgaagcaaaggtgaatgacagcctaggcttgaaattataaagctctctcaggttgaactctctcgtgcgctctcgctctcactttcgccctgtacctgagagcacaggtgtaactgtgatgtcatagtgccgagactactttcctttaaccattggggttaagttgggcagcccatttagtttacacgcgcataagactaatttacaaaatcactctatacagtcattagatgtaacatccttccctgagtagaaagtaatgcatgtgtttggagattattttctgtaatgctgggaacaaacctgttttaaaagcacactgctaaaagtaggtgatataagaccatttgctgtttttattaaagtatgtgtgtgtatcagtgtctcaatgtgaagattgtaacctcaagattaggaatcttaaaagagccacttagcctgaatgggaaacgtgagactatttttaaacacacacctctaaggaagaagcctcccatatagacttgatctcaaagaagcagataagaagacagaaaagtgttttaagtgtaagatctcctatggagtactttaaattcatttatacaaatgaataagtgtatctttgtataatgcataaatacatagataaaaacatgtttgctgccaaagttcccaataagatgcttcctgtgttttttggcctttacttagctgaatgatcaaagttcagaaaatggtctgcaaaagttactccatatacaaccccaaatctactactttaaatgtaacatcaactcagttgtatgaatctggagtgtaatatttatattagaatgtatatgtcatttaaaatattttgaaagccctcataaatatttatatttactaaactaatagcatagacactatataaatccgcagtgatgcttatatatcttaaattagtaataatgggtgctatataattattttcagttactatccctgacactctggaatcttctccatttctccctatcactcaatttcattttaatcattggacacctttgcgttttgctgctaacagtgtgtgtatgtcaccctctttatatctggttttcccacttgtctgaagctctcctgatcttagaacctggagctgcagattcctccatgtcagctcccatcacggccccaaagacagagtcacttggttgctgagtcacttggttgctggaaaaatctttggggaaagctggtataagctacacactgacctgtccccagtgtttccaggtaatgacttggcactccagagaaagtttcatgctgttgcgtgtggtggctccaagccaagcacctggcatgcaggtcagcccttcccagcgggcgtggcgtcgtcctcttcacagatgccacgttgcagccccaaggcctcaccattttgcgttttttagaaacccattttcttggtcatttataaagctgctttatagatatctttgatcctggcatgccttggtttcctctcccttccctctttccaatcctggtttcctaacctcctcttgtagtaattctcaactcaactcaaagtcccaagaatttggaatggtaggatgctgtgcggggagctcgaggctgaggcataatcactgcttcggttctgctcatcaggggacacgctcccttactcatggcagccatgtttgattgtcacagagccccccgaatactctgtctatagtgacacactgtaggtgtcataaattttaagaaacctgcttttaagtactatttataggtttttctgttatacttgcaacctagttttaaaatacatgaggattttatgaaagctttatacagacatttataggaaactcattctttgattttaggtgccatttaaattgataacacttactttataaaaagatgctttttgtctggatagagccttatagtttaaaatatcttcatatattgccatttgatcaaataaatttcttacttagaaaaaaaaaaaa

SEQ ID NO: 308841 - DNA, 712 bp, Homo sapiens
  misc_feature (42)..(42): n is a, c, g, or t
  misc_feature (56)..(56): n is a, c, g, or t
ccctggaggtacaaaaccttttttttgggggaaaaaaggttnaaaccaaaaaggtntctaaaaacaaagtctatgcaaaccacttaaaaataattccatagtagtttttcaggtcacgtttttgattcttatgcttcttgccagaaatacattatgataaagtggaaatacattacgatgaagtggaaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgactaaaaaaatgcgagaatgttgtatgtgactgaataacaatttttactctgcgaagccaaagtaaatataatattatcagtaactttatccccagtgtcagtatttataaaatgtttattaaggctagaaaaaatgaatacaatatcctgaaggtgaaatatattctcttcaattagcataaatatgatttacataagttagctatacagctattgagatagtactttctagtaaacttaaactactttttaaacatacattttgtgatgatttaacaaaaatatagagaatgatttgctttattgtaattgtatataagtgactggaaaagcacaaagaaataaagtgggttcgatctgtttaccaaaaaaaaaa

SEQ ID NO: 308842 - DNA, 6030 bp, Homo sapiens
  misc_feature (564)..(564): n is a, c, g, or t
  misc_feature (1483)..(1483): n is a, c, g, or t
agcgccgagtcctaggccaggtctggggtaacctggaacttccacctgggctctgcgctaggtctctgtttcactccctccccgcggggcgcgcagctcgcgggtctttggacaccaccggtcctgagtccgcggactgccattttcattaagaactgccacttagaggtaccaaaataaagggtatttgctacctttaatacttgccagttcaggttggaggcacaggcagcagcaagaatggaaagaaatgttcttacaacattttcacaggaaatgtcccagttaattttgaatgaaatgccaaaagctgaatattccagtttattcaatgattttgttgaatctgaattttttttgattgatggggattcattacttatcacatgtatctgtgagatatcatttaagcctgggcagaacctccatttcttctatctggttgaacgctatcttgtggatcttattagcaaaggaggacaattcaccatagttttcttcaaggatgccgagtatgcgtatttcaacttccctgaacttctttctttgagaactgctttaatncttcatcttcagaagaataccaccattgatgttcgaacaacattttcgagatgcttatcaaaagagtggggaagtttcttggaagagagttacccatatttcctgatagttgcagacgaaggcctgaacgatctacaaacacagcttttcaactttttaatcattcattcttgggcaaggaaggtcaacgttgtactttcctcagggcaagaatctgatgttctttgcctttatgcataccttcttccaagcatgtacagacaccagattttttcctggaagaataagcagaacattaaagatgcttatacaaccctgcttaaccagttggaaagatttaagctttcagcattagcacctctttttggaagtttaaaatggaataatattacggaagaggcacacaagactgtatctctgcttacacaagtctggccagaaggatctgacattcggcgtgtcttttgtgttacttcatgctcattatctttgagaatgtaccatcgctttttaggaaacagagagccctcctctggtcaggaaactgagatccaacaggtgaacagtaattgcttaaccctgcaggagatggaagatttgtgtaaactgcattgtctcactgtggtttttctactccatctgcctctttctcaaagagcttgtgctagagtcatcacttcccattgggctgaggacatgaagcctttattacaaatgaaaaagtggtgtgaatatttcatcttaagaaatatacatacttttgaattttggaatctgaatttaattcacctttctgacttaaatgatgagcttttgttgaagaatattgctttttactatgaaaatgaaaatgtaaaaggcctacatttgaatttgggagataccattatgaaagattatgaatatctctggaataccntatcaaagttggtcagagactttgaggttggacagccatttcctctgagaacaacaaaagtttgttttcttgaaaagaaaccatcaccaatcaaagacagctccaatgaaatggtgcccaatttgggttttattccaacgtcatcttttgtggttgataaatttgctggagatattttgaaagatttgccttttctaaagagtgatgatcctattgttacttcactggttaaacaaaaggaatttgatgaacttgtgcactggcattctcataaacccctgagtgatgattatgacaggtccaggtgtcagtttgatgaaaaatctagagaccctcgtgttcttagatctgtgcaaaagtatcatgttttccaacggttttatgggaattcattagaaacagtctcttcgaaaatcatcgtgactcaaactattaagtcaaagaaggattttagtgggcccaagagcaaaaaggcacacgagaccaaggctgaaataattgctagagagaataagaaaaggttatttgccagggaagaacaaaaggaagagcaaaagtggaatgctttgtcattttctattgaagagcaattgaaagaaaatttacactctggaataaagagcctggaagattttttgaaatcctgtaaaagtagctgtgtgaaacttcaggttgaaatggtggggttaactgcttgcttgaaagcctggaaagaacattgccgaagtgaagaaggtaaaaccacgaaagatttaagtatagctgttcaggtgatgaaaaggatccactccttgatggaaaaatactcagaacttttacaagaagatgatcggcaactcatagccagatgccttaagtatttaggatttgatgagttggcaagttctttacatccagcccaggatgcagaaaatgatgtaaaagtgaagaaaaggaataaatattcagttggcattgggccagctcggttccaactgcaatacatgggccattatttgatacgagatgagagaaaagacccagatcccagggtccaggattttattcccgacacatggcagcgagagctccttgatgttgtggataagaatgagtcagcagtgattgttgccccaacgtcctcaggcaaaacctatgcctcctactactgtatggagaaagtgctgaaggagagcgacgacggggtggtcgtgtacgttgcacccacaaaggcccttgttaatcaagtggcagcaactgttcagaatcgttttacgaaaaatctgccaagtggtgaagttctctgtggtgttttcaccagggagtatcgtcatgatgccttaaactgtcaggtacttattacagtgcctgcctgctttgaaattctgctgcttgctcctcatcgccaaaactgggtgaaaaagatcagatatgttatatttgatgaggttcattgtcttggtggagaaattggagcagaaatctgggaacatctccttgtcatgatccgatgtccctttttggctctttcagctaccataagtaatcctgaacatctcaccgagtggctacaatcggtaaaatggtactggaaacaagaagacaaaataattgaaaataataccgcttctaaaagacatgtgggtcgtcaggccggctttcccaaagactacttgcaagtaaaacaatcgtataaagttagacttgtgctctatggagagaggtataatgatctagagaagcatgtatgttcaataaaacatggtgacattcattttgatcattttcacccatgtgctgcactaacaacagatcatattgaaaggtatggattccctcctgatcttaccctttcacctcgagaaagcatccagctgtatgatgccatgtttcaaatttggaaaagttggcctcgggcccaggaactgtgcccagaaaacttcattcattttaacaataaattagtcattaaaaagatggatgctaggaaatatgaagagagtctaaaggcagaattaacaagttggattaaaaatggcaacgtagagcaggccagaatggtacttcagaatcttagtcctgaagcagatttgagtccagaaaacatgatcaccatgtttccacttctagttgaaaaactaaggaaaatggagaagttacctgcactattttttttattcaagttaggagctgtagaaaacgcagctgaaagtgtgagcactttcctaaagaaaaagcaggagacaaaaaggcctcccaaagctgataaagaagcccatgtcatggctaacaaacttcgaaaagttaaaaaatccatagagaaacaaaagatcatagatgaaaagagccagaaaaaaaccagaaatgtggatcaaagcctaatacatgaagctgaacatgataatctagtgaagtgtctagagaagaacctggaaatcccacaggactgcacatatgctgatcaaaaagcagtggacactgagactttgcagaaggtatttggtcgagtaaaatttgaaagaaaaggtgaagaattgaaagccttggcagaaaggggtattggatatcatcacagtgctatgagtttcaaagaaaaacaattagttgaaatcctctttagaaaaggatatcttagggtggtgacagctactggaacacttgctttaggtgtcaacatgccttgtaaatctgtggtttttgctcaaaactcagtctatctggatgcgttgaattatagacagatgtctggccgtgctggaagaagaggtcaagacctgatgggagatgtatatttctttgatattccattccccaaaataggaaaactcataaaatccaatgttcctgagctgagaggacacttccctctcagcataaccctggtcctgcgactcatgctgctggcttccaagggagatgacccagaggatgccaaggcaaaggtgctatcagtgctaaagcattcattgctgtccttcaagcaacccagagtcatggacatgttaaaactttacttcctgttttctttgcagttcctggtgaaagagggctatttagatcaagaaggtaatcctatggggtttgctggacttgtatcacatttgcattatcatgaaccttctaatcttgtttttgtcagttttcttgtaaatggactcttccatgatctctgtcagccaaccaggaaaggctcaaaacatttttctcaagacgttatggaaaagctagtattagtattggcacatctctttggaagaagatattttccaccaaagttccaagatgcacacttcgagttttatcaatcaaaggtgttccttgatgatctccctgaggattttagtgatgctttagatgaatataacatgaaaattatggaggactttaccactttcctacgaattgtttccaaactggctgatatgaatcaggaatatcaactcccattgtcaaaaatcaaattcacaggtaaagaatgtgaagactctcaactcgtatctcatttgatgagctgcaaggaaggaagagtagcaatttcaccatttgtttgtctgtctgggaactttgatgatgatttgcttcgactagaaactccaaaccatgttactctaggcacaatcggtgtcaatcgctctcaggctccagtgctgttgtcacagaaatttgataaccgaggaaggaaaatgtcgcttaatgcctatgcactggatttctacaaacatggttccttgataggattagtccaggataacaggatgaatgaaggagatgcttattatttgttgaaggattttgcactcaccattaaatctatcagtgtttccttgcgtgagctatgtgaaaatgaagacgacaacgttgtcttagcctttgaacaactgagtacaactttttgggaaaagttaaacaaagtctaaaaacaaagtctatgcaaaccacttaaaaataattccatagtagtttttcaggtcacgtttttgattcttatgcttcttgccagaaatacattatgataaagtggaaatacattacgatgaagtggaaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgactaaaaaaatgcgagaatgttgtatgtgactgaataacaatttttactctgcgaagccaaagtaaatataatattatcagtaactttatccccagtgtcagtatttataaaatgtttattaaggctagaaaaaatgaatacaatatcctgaaggtgaaatatattctcttcaattagcataaatatgatttacataagttagctatacagctattgagatagtactttctagtaaacttaaactactttttaaacatacattttgtgatgatttaacaaaaatatagagaatgatttgctttattgtaattgtatataagtgactggaaaagcacaaagaaataaagtgggttcgatctgtttaccaaaaaaaaaa

SEQ ID NO: 308843 - DNA, 9652 bp, Homo sapiens
  misc_feature (564)..(564): n is a, c, g, or t
  misc_feature (1483)..(1483): n is a, c, g, or t
agcgccgagtcctaggccaggtctggggtaacctggaacttccacctgggctctgcgctaggtctctgtttcactccctccccgcggggcgcgcagctcgcgggtctttggacaccaccggtcctgagtccgcggactgccattttcattaagaactgccacttagaggtaccaaaataaagggtatttgctacctttaatacttgccagttcaggttggaggcacaggcagcagcaagaatggaaagaaatgttcttacaacattttcacaggaaatgtcccagttaattttgaatgaaatgccaaaagctgaatattccagtttattcaatgattttgttgaatctgaattttttttgattgatggggattcattacttatcacatgtatctgtgagatatcatttaagcctgggcagaacctccatttcttctatctggttgaacgctatcttgtggatcttattagcaaaggaggacaattcaccatagttttcttcaaggatgccgagtatgcgtatttcaacttccctgaacttctttctttgagaactgctttaatncttcatcttcagaagaataccaccattgatgttcgaacaacattttcgagatgcttatcaaaagagtggggaagtttcttggaagagagttacccatatttcctgatagttgcagacgaaggcctgaacgatctacaaacacagcttttcaactttttaatcattcattcttgggcaaggaaggtcaacgttgtactttcctcagggcaagaatctgatgttctttgcctttatgcataccttcttccaagcatgtacagacaccagattttttcctggaagaataagcagaacattaaagatgcttatacaaccctgcttaaccagttggaaagatttaagctttcagcattagcacctctttttggaagtttaaaatggaataatattacggaagaggcacacaagactgtatctctgcttacacaagtctggccagaaggatctgacattcggcgtgtcttttgtgttacttcatgctcattatctttgagaatgtaccatcgctttttaggaaacagagagccctcctctggtcaggaaactgagatccaacaggtgaacagtaattgcttaaccctgcaggagatggaagatttgtgtaaactgcattgtctcactgtggtttttctactccatctgcctctttctcaaagagcttgtgctagagtcatcacttcccattgggctgaggacatgaagcctttattacaaatgaaaaagtggtgtgaatatttcatcttaagaaatatacatacttttgaattttggaatctgaatttaattcacctttctgacttaaatgatgagcttttgttgaagaatattgctttttactatgaaaatgaaaatgtaaaaggcctacatttgaatttgggagataccattatgaaagattatgaatatctctggaataccntatcaaagttggtcagagactttgaggttggacagccatttcctctgagaacaacaaaagtttgttttcttgaaaagaaaccatcaccaatcaaagacagctccaatgaaatggtgcccaatttgggttttattccaacgtcatcttttgtggttgataaatttgctggagatattttgaaagatttgccttttctaaagagtgatgatcctattgttacttcactggttaaacaaaaggaatttgatgaacttgtgcactggcattctcataaacccctgagtgatgattatgacaggtccaggtgtcagtttgatgaaaaatctagagaccctcgtgttcttagatctgtgcaaaagtatcatgttttccaacggttttatgggaattcattagaaacagtctcttcgaaaatcatcgtgactcaaactattaagtcaaagaaggattttagtgggcccaagagcaaaaaggcacacgagaccaaggctgaaataattgctagagagaataagaaaaggttatttgccagggaagaacaaaaggaagagcaaaagtggaatgctttgtcattttctattgaagagcaattgaaagaaaatttacactctggaataaagagcctggaagattttttgaaatcctgtaaaagtagctgtgtgaaacttcaggttgaaatggtggggttaactgcttgcttgaaagcctggaaagaacattgccgaagtgaagaaggtaaaaccacgaaagatttaagtatagctgttcaggtgatgaaaaggatccactccttgatggaaaaatactcagaacttttacaagaagatgatcggcaactcatagccagatgccttaagtatttaggatttgatgagttggcaagttctttacatccagcccaggatgcagaaaatgatgtaaaagtgaagaaaaggaataaatattcagttggcattgggccagctcggttccaactgcaatacatgggccattatttgatacgagatgagagaaaagacccagatcccagggtccaggattttattcccgacacatggcagcgagagctccttgatgttgtggataagaatgagtcagcagtgattgttgccccaacgtcctcaggcaaaacctatgcctcctactactgtatggagaaagtgctgaaggagagcgacgacggggtggtcgtgtacgttgcacccacaaaggcccttgttaatcaagtggcagcaactgttcagaatcgttttacgaaaaatctgccaagtggtgaagttctctgtggtgttttcaccagggagtatcgtcatgatgccttaaactgtcaggtacttattacagtgcctgcctgctttgaaattctgctgcttgctcctcatcgccaaaactgggtgaaaaagatcagatatgttatatttgatgaggttcattgtcttggtggagaaattggagcagaaatctgggaacatctccttgtcatgatccgatgtccctttttggctctttcagctaccataagtaatcctgaacatctcaccgagtggctacaatcggtaaaatggtactggaaacaagaagacaaaataattgaaaataataccgcttctaaaagacatgtgggtcgtcaggccggctttcccaaagactacttgcaagtaaaacaatcgtataaagttagacttgtgctctatggagagaggtataatgatctagagaagcatgtatgttcaataaaacatggtgacattcattttgatcattttcacccatgtgctgcactaacaacagatcatattgaaaggtatggattccctcctgatcttaccctttcacctcgagaaagcatccagctgtatgatgccatgtttcaaatttggaaaagttggcctcgggcccaggaactgtgcccagaaaacttcattcattttaacaataaattagtcattaaaaagatggatgctaggaaatatgaagagagtctaaaggcagaattaacaagttggattaaaaatggcaacgtagagcaggccagaatggtacttcagaatcttagtcctgaagcagatttgagtccagaaaacatgatcaccatgtttccacttctagttgaaaaactaaggaaaatggagaagttacctgcactattttttttattcaagttaggagctgtagaaaacgcagctgaaagtgtgagcactttcctaaagaaaaagcaggagacaaaaaggcctcccaaagctgataaagaagcccatgtcatggctaacaaacttcgaaaagttaaaaaatccatagagaaacaaaagatcatagatgaaaagagccagaaaaaaaccagaaatgtggatcaaagcctaatacatgaagctgaacatgataatctagtgaagtgtctagagaagaacctggaaatcccacaggactgcacatatgctgatcaaaaagcagtggacactgagactttgcagaaggtatttggtcgagtaaaatttgaaagaaaaggtgaagaattgaaagccttggcagaaaggggtattggatatcatcacagtgctatgagtttcaaagaaaaacaattagttgaaatcctctttagaaaaggatatcttagggtggtgacagctactggaacacttgctttaggtgtcaacatgccttgtaaatctgtggtttttgctcaaaactcagtctatctggatgcgttgaattatagacagatgtctggccgtgctggaagaagaggtcaagacctgatgggagatgtatatttctttgatattccattccccaaaataggaaaactcataaaatccaatgttcctgagctgagaggacacttccctctcagcataaccctggtcctgcgactcatgctgctggcttccaagggagatgacccagaggatgccaaggcaaaggtgctatcagtgctaaagcattcattgctgtccttcaagcaacccagagtcatggacatgttaaaactttacttcctgttttctttgcagttcctggtgaaagagggctatttagatcaagaaggtaatcctatggggtttgctggacttgtatcacatttgcattatcatgaaccttctaatcttgtttttgtcagttttcttgtaaatggactcttccatgatctctgtcagccaaccaggaaaggctcaaaacatttttctcaagacgttatggaaaagctagtattagtattggcacatctctttggaagaagatattttccaccaaagttccaagatgcacacttcgagttttatcaatcaaaggtgttccttgatgatctccctgaggattttagtgatgctttagatgaatataacatgaaaattatggaggactttaccactttcctacgaattgtttccaaactggctgatatgaatcaggaatatcaactcccattgtcaaaaatcaaattcacaggtaaagaatgtgaagactctcaactcgtatctcatttgatgagctgcaaggaaggaagagtagcaatttcaccatttgtttgtctgtctgggaactttgatgatgatttgcttcgactagaaactccaaaccatgttactctaggcacaatcggtgtcaatcgctctcaggctccagtgctgttgtcacagaaatttgataaccgaggaaggaaaatgtcgcttaatgcctatgcactggatttctacaaacatggttccttgataggattagtccaggataacaggatgaatgaaggagatgcttattatttgttgaaggattttgcactcaccattaaatctatcaggtgtgttatatatttaaatattgattttagattttttaataatttatttataatttgaaaaatgttgagctgttactataagccaggtacatgaaggtgccattaagcttcttctgtgctatgcatttcaactccccaaaggctctgcagaatgtctgttcaacacgtgttgtattatttctataacagaattaattccaatgtctagttgagatgaagtttcatccagactagagtctcagccccaggcatcatgcactgacaggcagcaatattcaaaagcttcattgactcctcgatcctggtattctcaattgccacaagcagtgtatgtcaaagacatgggacacgatatttcagagggctccttagggttccatccggtctctagtttatattcacttacatactttgaattttgtgttttctctgatgttttctccaggctccgtctgactctgatctttcatattggcctcctattttcacctttaacaaaacctagtggggtcccaagcaacaccaaactttatgtgggtaccccattcttaggcttcattgaccatctactgttgcttagttgcatgtccatctttctttttcttttcttttttttttgagacagaattttgcccttgttgcccaggctggagtgcaatggtatgatctcggctcaccacaacctctgcctcctgggttcaagcagttctcctgcctcaatctcctgagtagctgggattacaggcatgtgtcaccatgcccggctaatattgtatttttagtagcgagggggtttctccatgttggttagtgtggtctcgaactcctgacctcaggtgatctgcctgccttgccctcccaaagtgctgcggttacaggcattagctgccgctcctggcctaaatgtccatctttctaaagccttcaatctgcatgcaactcaatactttataggtgttgcttcgtcctatccctttttatatatttaatttgccacaactctctccattattaggttcttgctaatcaagtctctttttatatcttggatctgagcagaatcggcctgtttggactttttataacagagtaaaacttttgggagcagaaggaaactgctttgtccacttggaatatctctagatagggtattccttgagtggctcatagttactgaagttattatctccagagcagcccaagaaactccacagacttggaagctgtctcaaaaacttgggcaaggaaatcaatcaatcaatcattcacacattcatccaagaagtattgaagcattgttggtatgagacacacttcctaagcatttgagctataaaggttcataatttttttttttttttggagacggagagtcacgctctgtcacccaggctggagtgaagtgttgcgatctcggctcactgcaacctcacctcccaggttcaagcaattctcctgcctaagcctcccaggtagctgggactacaggtgtataccaccatgcctggctaatttttttttttttttggtattttagtacagatgggatttcaccatgctgcccaggctggtctcaaaattcctgagctcaggcaatccacccgccttggcctcccaaagtgctaggattacaggcaagaaccactgcgcctggccaaaggatcattaaattgatatacctgctttaaaaaaattcttacatgtgtagtgaaagaagctgacttatagaccttacaaacatggtcagagctatgatggcagataagggaatgactaatgtgacttgcattcaaagaaagagtctcaaatgaggtaattttttgactaagccttaaattatggggaagaagaaatagtattttcaaagtacagaaatgagaaagggcctgatgtgtcagggatagactccaagctcactatgtcaacatggagattatgggcatttgacagagatgggggaagatgctgggttgttgtaagagactttaaatggaatttggatctatatcaggaaaggtctttatgttaacattaagaagtttgggcttcatcttttgagcaacgtgtagacagtgcataagcctgaggggagcatgagcatgcggattatatatgtggcagaaatatgtaggtgcaaaggctgtaacagtcatgcaggtgaaaatgagtgaaggtctgaattaagggaattgaaatatgatgcagaagagtgatcagaaaaatatttacgaggtaaaattcaagaaattggtaaaaaaatttatgcagttggtaaagatgaccaaagttcctatttttgttaaggatgtataggaaacaaggatgagcatgacatttggggatgagaatgaaaaatagtgagctagaatttatacacatcacattatatctgggagatatcaatcaggaggaaatgttcagtagtcacaatgataagtctgtaactcagaaggaaatttggtgttgtagagacagaactgatcaatttttgtggtaggtcagtgatgacactcgaaaataactggaactctagtggaaacaaggtaggggcaaataataaaaggctgataagatgtcagatcatgacagttttcagcccttgatcagtccagctgtactgttcattcttggatttcttctctccttttttgttacctgtacattagtttcttaatgctgctgcaacaaattaccacaaacctagtggcttaaaccaacacaaatttattattttacaattctggaggtcagaagtccaaaatgtgtcttcttgggctcaatccagttgtcagcagggctgcatttctttgtaaaggctcttaagggacaatctacttttattgccttttccaacttttagaggctgccggcattccttggcttgtggctccctttcatctccaaagccagcaatggttcgtagactcacactgcatcattctgactctctcctgcctcactcttccacttacagggacctttgagatcacactgaacctgcccagataatccaggattattttcctatctcaaggtcagctgattcgcaactttaattcgcactgcagccataattcattcccctttgccatgtaacctgacctattcatcggtttctggggaatatatgatatggacatctttgcagggccattattctgcttaccatatcttgttgtccttatctttttacacatctaggtaaagaaagcaatattttcctcttcgtagatgtagctgcctgtgggtttcagtatacactggacactagcataaataacacaaaatgactccacaagagatatgtagaggaaagaaaaggaatttgcgttgcacttttgaagggagaagggatcaagttatgtggaatttgatggcttttcagactctcttggtaatagtcatggagaagaattgcatggggttgttttgttatcttttcttaaattttttatacaagattttttaggagaaatatgtttcttatcattattcctcatattttgctaacataatttcatcatctgatgggatttccttacttctgcctaaccaaggaaagcctttcttataatattcaatctcactaaagtggatcctatatttttttccccatttccagtgtttccttgcgtgagctatgtgaaaatgaagacgacaacgttgtcttagcctttgaacaactgagtacaactttttgggaaaagttaaacaaagtctaaaaacaaagtctatgcaaaccacttaaaaataattccatagtagtttttcaggtcacgtttttgattcttatgcttcttgccagaaatacattatgataaagtggaaatacattacgatgaagtggaaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgactaaaaaaatgcgagaatgttgtatgtgactgaataacaatttttactctgcgaagccaaagtaaatataatattatcagtaactttatccccagtgtcagtatttataaaatgtttattaaggctagaaaaaatgaatacaatatcctgaaggtgaaatatattctcttcaattagcataaatatgatttacataagttagctatacagctattgagatagtactttctagtaaacttaaactactttttaaacatacattttgtgatgatttaacaaaaatatagagaatgatttgctttattgtaattgtatataagtgactggaaaagcacaaagaaataaagtgggttcgatctgtttaccaaaaaaaaaa

SEQ ID NO: 308844 - DNA, 4234 bp, Homo sapiens
ttaacagaggcttaatttccaaaagaaaaaaagaaatttttcacatctactcaaaatgggatgatggtcaaagtcttcaatacacccataatattgtctcactcatgacctgttatcttggaatattttcaacttgtcttaagagatgttttttcctttggggcaggagaccaaggctgaaataattgctagagagaataagaaaaggttatttgccagggaagaacaaaaggaagagcaaaagtggaatgctttgtcattttctattgaagagcaattgaaagaaaatttacactctggaataaagagcctggaagattttttgaaatcctgtaaaagtagctgtgtgaaacttcaggttgaaatggtggggttaactgcttgcttgaaagcctggaaagaacattgccgaagtgaagaaggtaaaaccacgaaagatttaagtatagctgttcaggtgatgaaaaggatccactccttgatggaaaaatactcagaacttttacaagaagatgatcggcaactcatagccagatgccttaagtatttaggatttgatgagttggcaagttctttacatccagcccaggatgcagaaaatgatgtaaaagtgaagaaaaggaataaatattcagttggcattgggccagctcggttccaactgcaatacatgggccattatttgatacgagatgagagaaaagacccagatcccagggtccaggattttattcccgacacatggcagcgagagctccttgatgttgtggataagaatgagtcagcagtgattgttgccccaacgtcctcaggcaaaacctatgcctcctactactgtatggagaaagtgctgaaggagagcgacgacggggtggtcgtgtacgttgcacccacaaaggcccttgttaatcaagtggcagcaactgttcagaatcgttttacgaaaaatctgccaagtggtgaagttctctgtggtgttttcaccagggagtatcgtcatgatgccttaaactgtcaggtacttattacagtgcctgcctgctttgaaattctgctgcttgctcctcatcgccaaaactgggtgaaaaagatcagatatgttatatttgatgaggttcattgtcttggtggagaaattggagcagaaatctgggaacatctccttgtcatgatccgatgtccctttttggctctttcagctaccataagtaatcctgaacatctcaccgagtggctacaatcggtaaaatggtactggaaacaagaagacaaaataattgaaaataataccgcttctaaaagacatgtgggtcgtcaggccggctttcccaaagactacttgcaagtaaaacaatcgtataaagttagacttgtgctctatggagagaggtataatgatctagagaagcatgtatgttcaataaaacatggtgacattcattttgatcattttcacccatgtgctgcactaacaacagatcatattgaaaggtatggattccctcctgatcttaccctttcacctcgagaaagcatccagctgtatgatgccatgtttcaaatttggaaaagttggcctcgggcccaggaactgtgcccagaaaacttcattcattttaacaataaattagtcattaaaaagatggatgctaggaaatatgaagagagtctaaaggcagaattaacaagttggattaaaaatggcaacgtagagcaggccagaatggtacttcagaatcttagtcctgaagcagatttgagtccagaaaacatgatcaccatgtttccacttctagttgaaaaactaaggaaaatggagaagttacctgcactattttttttattcaagttaggagctgtagaaaacgcagctgaaagtgtgagcactttcctaaagaaaaagcaggagacaaaaaggcctcccaaagctgataaagaagcccatgtcatggctaacaaacttcgaaaagttaaaaaatccatagagaaacaaaagatcatagatgaaaagagccagaaaaaaaccagaaatgtggatcaaagcctaatacatgaagctgaacatgataatctagtgaagtgtctagagaagaacctggaaatcccacaggactgcacatatgctgatcaaaaagcagtggacactgagactttgcagaaggtatttggtcgagtaaaatttgaaagaaaaggtgaagaattgaaagccttggcagaaaggggtattggatatcatcacagtgctatgagtttcaaagaaaaacaattagttgaaatcctctttagaaaaggatatcttagggtggtgacagctactggaacacttgctttaggtgtcaacatgccttgtaaatctgtggtttttgctcaaaactcagtctatctggatgcgttgaattatagacagatgtctggccgtgctggaagaagaggtcaagacctgatgggagatgtatatttctttgatattccattccccaaaataggaaaactcataaaatccaatgttcctgagctgagaggacacttccctctcagcataaccctggtcctgcgactcatgctgctggcttccaagggagatgacccagaggatgccaaggcaaaggtgctatcagtgctaaagcattcattgctgtccttcaagcaacccagagtcatggacatgttaaaactttacttcctgttttctttgcagttcctggtgaaagagggctatttagatcaagaaggtaatcctatggggtttgctggacttgtatcacatttgcattatcatgaaccttctaatcttgtttttgtcagttttcttgtaaatggactcttccatgatctctgtcagccaaccaggaaaggctcaaaacatttttctcaagacgttatggaaaagctagtattagtattggcacatctctttggaagaagatattttccaccaaagttccaagatgcacacttcgagttttatcaatcaaaggtgttccttgatgatctccctgaggattttagtgatgctttagatgaatataacatgaaaattatggaggactttaccactttcctacgaattgtttccaaactggctgatatgaatcaggaatatcaactcccattgtcaaaaatcaaattcacaggtaaagaatgtgaagactctcaactcgtatctcatttgatgagctgcaaggaaggaagagtagcaatttcaccatttgtttgtctgtctgggaactttgatgatgatttgcttcgactagaaactccaaaccatgttactctaggcacaatcggtgtcaatcgctctcaggctccagtgctgttgtcacagaaatttgataaccgaggaaggaaaatgtcgcttaatgcctatgcactggatttctacaaacatggttccttgataggattagtccaggataacaggatgaatgaaggagatgcttattatttgttgaaggattttgcactcaccattaaatctatcagtgtttccttgcgtgagctatgtgaaaatgaagacgacaacgttgtcttagcctttgaacaactgagtacaactttttgggaaaagttaaacaaagtctaaaaacaaagtctatgcaaaccacttaaaaataattccatagtagtttttcaggtcacgtttttgattcttatgcttcttgccagaaatacattatgataaagtggaaatacattacgatgaagtggaaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgactaaaaaaatgcgagaatgttgtatgtgactgaataacaatttttactctgcgaagccaaagtaaatataatattatcagtaactttatccccagtgtcagtatttataaaatgtttattaaggctagaaaaaatgaatacaatatcctgaaggtgaaatatattctcttcaattagcataaatatgatttacataagttagctatacagctattgagatagtactttctagtaaacttaaactactttttaaacatacattttgtgatgatttaacaaaaatatagagaatgatttgctttattgtaattgtatataagtgactggaaaagcacaaagaaataaagtgggttcgatctgtttaccaaaaaaaaaa

SEQ ID NO: 308845 - DNA, 5994 bp, Homo sapiens
  misc_feature (564)..(564): n is a, c, g, or t
  misc_feature (1483)..(1483): n is a, c, g, or t
agcgccgagtcctaggccaggtctggggtaacctggaacttccacctgggctctgcgctaggtctctgtttcactccctccccgcggggcgcgcagctcgcgggtctttggacaccaccggtcctgagtccgcggactgccattttcattaagaactgccacttagaggtaccaaaataaagggtatttgctacctttaatacttgccagttcaggttggaggcacaggcagcagcaagaatggaaagaaatgttcttacaacattttcacaggaaatgtcccagttaattttgaatgaaatgccaaaagctgaatattccagtttattcaatgattttgttgaatctgaattttttttgattgatggggattcattacttatcacatgtatctgtgagatatcatttaagcctgggcagaacctccatttcttctatctggttgaacgctatcttgtggatcttattagcaaaggaggacaattcaccatagttttcttcaaggatgccgagtatgcgtatttcaacttccctgaacttctttctttgagaactgctttaatncttcatcttcagaagaataccaccattgatgttcgaacaacattttcgagatgcttatcaaaagagtggggaagtttcttggaagagagttacccatatttcctgatagttgcagacgaaggcctgaacgatctacaaacacagcttttcaactttttaatcattcattcttgggcaaggaaggtcaacgttgtactttcctcagggcaagaatctgatgttctttgcctttatgcataccttcttccaagcatgtacagacaccagattttttcctggaagaataagcagaacattaaagatgcttatacaaccctgcttaaccagttggaaagatttaagctttcagcattagcacctctttttggaagtttaaaatggaataatattacggaagaggcacacaagactgtatctctgcttacacaagtctggccagaaggatctgacattcggcgtgtcttttgtgttacttcatgctcattatctttgagaatgtaccatcgctttttaggaaacagagagccctcctctggtcaggaaactgagatccaacaggtgaacagtaattgcttaaccctgcaggagatggaagatttgtgtaaactgcattgtctcactgtggtttttctactccatctgcctctttctcaaagagcttgtgctagagtcatcacttcccattgggctgaggacatgaagcctttattacaaatgaaaaagtggtgtgaatatttcatcttaagaaatatacatacttttgaattttggaatctgaatttaattcacctttctgacttaaatgatgagcttttgttgaagaatattgctttttactatgaaaatgaaaatgtaaaaggcctacatttgaatttgggagataccattatgaaagattatgaatatctctggaataccntatcaaagttggtcagagactttgaggttggacagccatttcctctgagaacaacaaaagtttgttttcttgaaaagaaaccatcaccaatcaaagacagctccaatgaaatggtgcccaatttgggttttattccaacgtcatcttttgtggttgataaatttgctggagatattttgaaagatttgccttttctaaagagtgatgatcctattgttacttcactggttaaacaaaaggaatttgatgaacttgtgcactggcattctcataaacccctgagtgatgattatgacaggtccaggtgtcagtttgatgaaaaatctagagaccctcgtgttcttagatctgtgcaaaagtatcatgttttccaacggttttatgggaattcattagaaacagtctcttcgaaaatcatcgtgactcaaactattaagtcaaagaaggattttagtgggcccaagagcaaaaaggcacacgagaccaaggctgaaataattgctagagagaataagaaaaggttatttgccagggaagaacaaaaggaagagcaaaagtggaatgctttgtcattttctattgaagagcaattgaaagaaaatttacactctggaataaagagcctggaagattttttgaaatcctgtaaaagtagctgtgtgaaacttcaggttgaaatggtggggttaactgcttgcttgaaagcctggaaagaacattgccgaagtgaagaaggtaaaaccacgaaagatttaagtatagctgttcaggtgatgaaaaggatccactccttgatggaaaaatactcagaacttttacaagaagatgatcggcaactcatagccagatgccttaagtatttaggatttgatgagttggcaagttctttacatccagcccaggatgcagaaaatgatgtaaaagtgaagaaaaggaataaatattcagttggcattgggccagctcggttccaactgcaatacatgggccattatttgatacgagatgagagaaaagacccagatcccagggtccaggattttattcccgacacatggcagcgagagctccttgatgttgtggataagaatgagtcagcagtgattgttgccccaacgtcctcaggcaaaacctatgcctcctactactgtatggagaaagtgctgaaggagagcgacgacggggtggtcgtgtacgttgcacccacaaaggcccttgttaatcaagtggcagcaactgttcagaatcgttttacgaaaaatctgccaagtggtgaagttctctgtggtgttttcaccagggagtatcgtcatgatgccttaaactgtcaggtacttattacagtgcctgcctgctttgaaattctgctgcttgctcctcatcgccaaaactgggtgaaaaagatcagatatgttatatttgatgaggttcattgtcttggtggagaaattggagcagaaatctgggaacatctccttgtcatgatccgatgtccctttttggctctttcagctaccataagtaatcctgaacatctcaccgagtggctacaatcggtaaaatggtactggaaacaagaagacaaaataattgaaaataataccgcttctaaaagacatgtgggtcgtcaggccggctttcccaaagactacttgcaagtaaaacaatcgtataaagttagacttgtgctctatggagagaggtataatgatctagagaagcatgtatgttcaataaaacatggtgacattcattttgatcattttcacccatgtgctgcactaacaacagatcatattgaaaggtatggattccctcctgatcttaccctttcacctcgagaaagcatccagctgtatgatgccatgtttcaaatttggaaaagttggcctcgggcccaggaactgtgcccagaaaacttcattcattttaacaataaattagtcattaaaaagatggatgctaggaaatatgaagagagtctaaaggcagaattaacaagttggattaaaaatggcaacgtagagcaggccagaatggtacttcagaatcttagtcctgaagcagatttgagtccagaaaacatgatcaccatgtttccacttctagttgaaaaactaaggaaaatggagaagttacctgcactattttttttattcaagttaggagctgtagaaaacgcagctgaaagtgtgagcactttcctaaagaaaaagcaggagacaaaaaggcctcccaaagctgataaagaagcccatgtcatggctaacaaacttcgaaaagttaaaaaatccatagagaaacaaaagatcatagatgaaaagagccagaaaaaaaccagaaatgtggatcaaagcctaatacatgaagctgaacatgataatctagtgaagtgtctagagaagaacctggaaatcccacaggactgcacatatgctgatcaaaaagcagtggacactgagactttgcagaaggtatttggtcgagtaaaatttgaaagaaaaggtgaagaattgaaagccttggcagaaaggggtattggatatcatcacagtgctatgagtttcaaagaaaaacaattagttgaaatcctctttagaaaaggatatcttagggtggtgacagctactggaacacttgctttaggtgtcaacatgccttgtaaatctgtggtttttgctcaaaactcagtctatctggatgcgttgaattatagacagatgtctggccgtgctggaagaagaggtcaagacctgatgggagatgtatatttctttgatattccattccccaaaataggaaaactcataaaatccaatgttcctgagctgagaggacacttccctctcagcataaccctggtcctgcgactcatgctgctggcttccaagggagatgacccagaggatgccaaggcaaaggtgctatcagtgctaaagcattcattgctgtccttcaagcaacccagagtcatggacatgttaaaactttacttcctgttttctttgcagttcctggtgaaagagggctatttagatcaagaaggtaatcctatggggtttgctggacttgtatcacatttgcattatcatgaaccttctaatcttgtttttgtcagttttcttgtaaatggactcttccatgatctctgtcagccaaccaggaaaggctcaaaacatttttctcaagacgttatggaaaagctagtattagtattggcacatctctttggaagaagatattttccaccaaagttccaagatgcacacttcgagttttatcaatcaaaggtgttccttgatgatctccctgaggattttagtgatgctttagatgaatataacatgaaaattatggaggactttaccactttcctacgaattgtttccaaactggctgatatgaatcaggaatatcaactcccattgtcaaaaatcaaattcacaggtaaagaatgtgaagactctcaactcgtatctcatttgatgagctgcaaggaaggaagagtagcaatttcaccatttgtttgtctgtctgggaactttgatgatgatttgcttcgactagaaactccaaaccatgctccagtgctgttgtcacagaaatttgataaccgaggaaggaaaatgtcgcttaatgcctatgcactggatttctacaaacatggttccttgataggattagtccaggataacaggatgaatgaaggagatgcttattatttgttgaaggattttgcactcaccattaaatctatcagtgtttccttgcgtgagctatgtgaaaatgaagacgacaacgttgtcttagcctttgaacaactgagtacaactttttgggaaaagttaaacaaagtctaaaaacaaagtctatgcaaaccacttaaaaataattccatagtagtttttcaggtcacgtttttgattcttatgcttcttgccagaaatacattatgataaagtggaaatacattacgatgaagtggaaagagcaaacactttggaatcaaacagagttgcaatcaaacctgccatgttctgtcatgaatactcacaaattatttagtatacctgaatcttggtttctttttataactgagtaataatggttacatctcaggtagtttgaggattgactaaaaaaatgcgagaatgttgtatgtgactgaataacaatttttactctgcgaagccaaagtaaatataatattatcagtaactttatccccagtgtcagtatttataaaatgtttattaaggctagaaaaaatgaatacaatatcctgaaggtgaaatatattctcttcaattagcataaatatgatttacataagttagctatacagctattgagatagtactttctagtaaacttaaactactttttaaacatacattttgtgatgatttaacaaaaatatagagaatgatttgctttattgtaattgtatataagtgactggaaaagcacaaagaaataaagtgggttcgatctgtttaccaaaaaaaaaa

SEQ ID NO: 308846 - DNA, 4248 bp, Homo sapiens
  misc_feature (564)..(564): n is a, c, g, or t
  misc_feature (1483)..(1483): n is a, c, g, or t
agcgccgagtcctaggccaggtctggggtaacctggaacttccacctgggctctgcgctaggtctctgtttcactccctccccgcggggcgcgcagctcgcgggtctttggacaccaccggtcctgagtccgcggactgccattttcattaagaactgccacttagaggtaccaaaataaagggtatttgctacctttaatacttgccagttcaggttggaggcacaggcagcagcaagaatggaaagaaatgttcttacaacattttcacaggaaatgtcccagttaattttgaatgaaatgccaaaagctgaatattccagtttattcaatgattttgttgaatctgaattttttttgattgatggggattcattacttatcacatgtatctgtgagatatcatttaagcctgggcagaacctccatttcttctatctggttgaacgctatcttgtggatcttattagcaaaggaggacaattcaccatagttttcttcaaggatgccgagtatgcgtatttcaacttccctgaacttctttctttgagaactgctttaatncttcatcttcagaagaataccaccattgatgttcgaacaacattttcgagatgcttatcaaaagagtggggaagtttcttggaagagagttacccatatttcctgatagttgcagacgaaggcctgaacgatctacaaacacagcttttcaactttttaatcattcattcttgggcaaggaaggtcaacgttgtactttcctcagggcaagaatctgatgttctttgcctttatgcataccttcttccaagcatgtacagacaccagattttttcctggaagaataagcagaacattaaagatgcttatacaaccctgcttaaccagttggaaagatttaagctttcagcattagcacctctttttggaagtttaaaatggaataatattacggaagaggcacacaagactgtatctctgcttacacaagtctggccagaaggatctgacattcggcgtgtcttttgtgttacttcatgctcattatctttgagaatgtaccatcgctttttaggaaacagagagccctcctctggtcaggaaactgagatccaacaggtgaacagtaattgcttaaccctgcaggagatggaagatttgtgtaaactgcattgtctcactgtggtttttctactccatctgcctctttctcaaagagcttgtgctagagtcatcacttcccattgggctgaggacatgaagcctttattacaaatgaaaaagtggtgtgaatatttcatcttaagaaatatacatacttttgaattttggaatctgaatttaattcacctttctgacttaaatgatgagcttttgttgaagaatattgctttttactatgaaaatgaaaatgtaaaaggcctacatttgaatttgggagataccattatgaaagattatgaatatctctggaataccntatcaaagttggtcagagactttgaggttggacagccatttcctctgagaacaacaaaagtttgttttcttgaaaagaaaccatcaccaatcaaagacagctccaatgaaatggtgcccaatttgggttttattccaacgtcatcttttgtggttgataaatttgctggagatattttgaaagatttgccttttctaaagagtgatgatcctattgttacttcactggttaaacaaaaggaatttgatgaacttgtgcactggcattctcataaacccctgagtgatgattatgacaggtccaggtgtcagtttgatgaaaaatctagagaccctcgtgttcttagatctgtgcaaaagtatcatgttttccaacggttttatgggaattcattagaaacagtctcttcgaaaatcatcgtgactcaaactattaagtcaaagaaggattttagtgggcccaagagcaaaaaggcacacgagaccaaggctgaaataattgctagagagaataagaaaaggttatttgccagggaagaacaaaaggaagagcaaaagtggaatgctttgtcattttctattgaagagcaattgaaagaaaatttacactctggaataaagagcctggaagattttttgaaatcctgtaaaagtagctgtgtgaaacttcaggttgaaatggtggggttaactgcttgcttgaaagcctggaaagaacattgccgaagtgaagaaggtaaaaccacgaaagatttaagtatagctgttcaggtgatgaaaaggatccactccttgatggaaaaatactcagaacttttacaagaagatgatcggcaactcatagccagatgccttaagtatttaggatttgatgagttggcaagttctttacatccagcccaggatgcagaaaatgatgtaaaagtgaagaaaaggaataaatattcagttggcattgggccagctcggttccaactgcaatacatgggccattatttgatacgagatgagagaaaagacccagatcccagggtccaggattttattcccgacacatggcagcgagagctccttgatgttgtggataagaatgagtcagcagtgattgttgccccaacgtcctcaggcaaaacctatgcctcctactactgtatggagaaagtgctgaaggagagcgacgacggggtggtcgtgtacgttgcacccacaaaggcccttgttaatcaagtggcagcaactgttcagaatcgttttacgaaaaatctgccaagtggtgaagttctctgtggtgttttcaccagggagtatcgtcatgatgccttaaactgtcaggtacttattacagtgcctgcctgctttgaaattctgctgcttgctcctcatcgccaaaactgggtgaaaaagatcagatatgttatatttgatgaggttcattgtcttggtggagaaattggagcagaaatctgggaacatctccttgtcatgatccgatgtccctttttggctctttcagctaccataagtaatcctgaacatctcaccgaccagcagtgtctcacacatccggctcaacacatggtcactggcacacaccaagcacagcacacaacatcaatttgcaacacatcacatcaccctgcttctcaaacagcaccatgataagagtcagatcaaggctcaggcatatttcccagaacagcactcaacattgccacagttcaacacaccaacatctgtcatcacacagttcaagcacctatgttagcttccataacttgcgcacgccacgcaagcgtacatcacatcgcatccatcaagccagcacacagaccattgatacattgcttaatacacacttaagccaacacaatagaggtaggacagctgctatcaaactactgatggacttcaaaataataaccagcgaccaaatgattcgactaggcgaaagatatcaacacaagcaggacttcaataccatgtgaaacacaggggtactggggacatattcaccatcgccttggacatcatttaccacacatgttacaaccccataccgcacagcaacagagacgaaaaccacaagagcgtgggatacttgggaactgcaccaatggatccgcccaaaccgttacgcggagcacaccacacgcgagggggcaccatacagagtacgccacacaggcggcaaccactgggactgaaaccaccagcgaacaaccagcaagaccacgtccaaacatccgtcgaaaacgacaacatccacacacatgaaggtacacactgacaacacaacgagccagtaggaaacggctacgtgaccacacccagatgcccaacgatagacaggcccctacaacagcgggcccaggcacaatacacaccgcacggctagaggtgcactgaaccatcaacgtggggaacaaccgccacccacacacacgaggcccccgagcaagagggactaagtcagagaaacactcccgacgcgcccgcggacaggcacacagtcagagcgaggcacacgaacaacagcgactgccacacgcccaggtagagccagcgacgcaccgcgcagcgcagctcaagcacacgtgcgagcgaagcaccacagcacaaacaacaagaacgataacagaggaagagcccgacacaaacaagccacgacggtctaaccgatgcacgaacacagccagacagaccgcagagcgccaacacaggcgtcgcccatcgaacagaaagacgggcaactcgaagcagaacaga

SEQ ID NO: 308847 - DNA, 479 bp, Homo sapiens
cagtggctggaccaggcctggtgtgtgtaagtgtccaagaagctgaagtgacattgtccttctgcctccatccctgggcttcctccccaaggagcgggagaagattgtggctcccatcagtgactccccgaagccaccgccacagcgtgtgaccctcacgctacctgtcctgaatgcagcacgaactgtcatctttgtggcaactggagaaggcaaggcagctgttctgaaggtaacagctgagggttctagtcctgggaagttcatgggcatgtgggccccagggacagaaaatggccccagacattattgtgctgaagcatcagatctgaagaaaactcagtcattcttgggttgaaaggtaacttgaaattgcaattagaaaaaaaggaaaaaaaaaaaaaaaaccccagaaaattgcaattaaaggctagttaggtattaaccgctatgaaatgaaattgatgagatgaggccaa

SEQ ID NO: 308848 - DNA, 1262 bp, Homo sapiens
gcagggccggcccttgcgcaggcgtactagcgacggccgtagggagcgcttcctcctccccgccgccgccctcgccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacgctacctgtcctgaatgcagcacgaactgtcatctttgtggcaactggagaaggcaaggcagctgttctgaagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaaaaaaaaaaaaaacacaaacagaaacacgacaaaaacacaaaacaaaacaaaagaagacacaacaacacaaagagaaaaagcagcgcgggacgagtggggggcggagaacaaagaaataagagagcgaagaaagagtatcacgacacacttgtggaagaggagaagggcgccccccagagggggaataaagagagccgcgcaa

SEQ ID NO: 308849 - DNA, 1060 bp, Homo sapiens
gcagggccggcccttgcgcaggcgtactagcgacggccgtagggagcgcttcctcctccccgccgccgccctcgccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacgctacctgtcctgaatgcagcacgaactgtcatctttgtggcaactggagaaggcaaggcagctgttctgaagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaa

SEQ ID NO: 308850 - DNA, 965 bp, Homo sapiens
gcagggccggcccttgcgcaggcgtactagcgacggccgtagggagcgcttcctcctccccgccgccgccctcgccatggccgcgccggccccgggcctcatctcggtgttctcgagttcccaggagctgggtgcggcgctagcgcagctggtggcccagcgcgcagcatgctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacgctacctgtcctgaatgcagcacgaactgtcatctttgtggcaactggagaaggcaaggcagctgttctgaagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaa

SEQ ID NO: 308851 - DNA, 1149 bp, Homo sapiens
gccgtgggaccctggaggctttgaaacaggacaatgggctggctagacaggtgcaggctatggccaggaaaccccccaaatacaacggaattgaaagactcctgttggaatgctggcccccgcaggaaccaccatgatcccgattcacccaggagggccaccctcccgtccagccccccaagagcagcagggctccctcttgcccttgaacctcctctgccctgacaggcggcgtcacccagggctcaggatcctggcttccagcattccagaggtgactcaccaaccaaagtgtcactcaccaaccgaaggaccttgcacaaatgcaccagcctccccatgcctcagtctccccatctgtaaatgagtgttatgacggtactgtcataaactccctggaggatccaggtggtcacgttactgttggtgacattgtccctctgttggctgcagacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacgctacctgtcctgaatgcagcacgaactgtcatctttgtggcaactggagaaggcaaggcagctgttctgaagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaa

SEQ ID NO: 308852 - DNA, 734 bp, Homo sapiens
cactcatttcacagatggagaaactgaggccagaagagacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacgctacctgtcctgaatgcagcacgaactgtcatctttgtggcaactggagaaggcaaggcagctgttctgaagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaa

SEQ ID NO: 308853 - DNA, 884 bp, Homo sapiens
  misc_feature (44)..(44): n is a, c, g, or t
  misc_feature (51)..(51): n is a, c, g, or t
  misc_feature (80)..(80): n is a, c, g, or t
  misc_feature (140)..(140): n is a, c, g, or t
attacatttcctgatgctttcaaggccatattccaaaagtatcncagatgncaaatagaatatgctatataaaccaaaantgtgcatttcagatgacctattacagcggcgatagaccccagagcccacaggcgtacttnccaggcactgatccattggaggagggccatggtgccggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacgctacctgtcctgaatgcagcacgaactgtcatctttgtggcaactggagaaggcaaggcagctgttctgaagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaa

SEQ ID NO: 308854 - DNA, 1164 bp, Homo sapiens
gcagggccggcccttgcgcaggcgtactagcgacggccgtagggagcgcttcctcctccccgccgccgccctcgccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggaactgccccagggatcactggcagatccctttgaggaatcccctcttcgaggccacagccctgccctggggagcctgaaggccactcggcctctgttgcccaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacgctacctgtcctgaatgcagcacgaactgtcatctttgtggcaactggagaaggcaaggcagctgttctgaagcgcattttggaggaccaggaggaaaacccgctgcccgccgccctggtccagccccacaccgggaaactgtgctggttcttggacgaggcggccgcccgcctcctgaccgtgcccttcgagaagcattccactttgtagctggccagagggacgccgcagctgggaccaggcacgcggcccatggggctgggcccctgctggccgccactctccgggctctcctttcaaaaagccacgtcgtgctgctgctggaagccaacagcctccggccagcagccctacccggggctcaacacacaggctgtggctctggacatccggatattaaaaggagcgttgctggaa

SEQ ID NO: 308855 - DNA, 962 bp, Homo sapiens
gcagggccggcccttgcgcaggcgtactagcgacggccgtagggagcgcttcctcctccccgccgccgccctcgccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccggacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgctcactcttcccagaccaccccctcctacaggagcgggagaagattgtggctcccatcagtgactccccgaagccaccgccacagcgtgtgaccctcacgctacctgtcctgaatgcagcacgaactgtcatctttgtggcaactggagaaggcaaggcagctgttctgaaggtaacagctgagggttctagtcctgggaagttcatgggcatgtgggccccagggacagaaaatggccccagacattattgtgctgaagcatcagatctgaagaaaactcagtcattcttgggttgaaaggtaacttgaaattgcaattagaaaaaaaggaaaaaaaaaaaaaaaaccccagaaaattgcaattaaaggctagttaggtattaaccgctatgaaatgaaattgatgagatgaggccaa

SEQ ID NO: 308856 - DNA, 812 bp, Homo sapiens
gccgtgggaccctggaggctttgaaacaggacaatgggctggctagacaggtgcaggctatggccaggaaaccccccaaatacaacggaattgaaagactcctgttggaatgctggcccccgcaggaaccaccatgatcccgattcacccaggagggccaccctcccgtccagccccccaagagcagcagggctccctcttgcccttgaacctcctctgccctgacaggcggcgtcacccagggctcaggatcctggcttccagcattccagaggtgactcaccaaccaaagtgtcactcaccaaccgaaggaccttgcacaaatgcaccagcctccccatgcctcagtctccccatctgtaaatgagtgttatgacggtactgtcataaactccctggaggatccaggtggtcacgttactgttggtgacattgtccctctgttggctgcagacgcatcttctctccagactgccgatcccagaaagccaggtgatcaccattaaccccgagctgcctgtggaggaggcggctgaggactacgccaagaagctgagacaggcattccaaggggactccatcccggttttcgacctgctgatcctgggggtgggccccgatggtcacacctgccaccttgtagaggttgtggaggtgaacggggtctgcgtggaggggaagcagcatggggacgtggtgtccgccatcagggctggcggggacgagaccaagctgctggtggtggacagggaaactgacgagttcttcaagaaatgcagagtgatcccatctcacgagcacctgaatgtctc

SEQ ID NO: 308857 - DNA, 836 bp, Homo sapiens
gcagggccggcccttgcgcaggcgtactagcgacggccgtagggagcgcttcctcctccccgccgccgccctcgccatggccgcgccggccccgggcctcatctcggtgttctcgagttcccaggagctgggtgcggcgctagcgcagctggtggcccagcgcgcagcatgctgcctggcaggggcccgcgcccgtttcgcgctcggcctgtcgggcgggagcctcgtctcgatgctagcccgcgagctacccgccgccgtcgcccctgccgggccagctagcttagcgcgctggacgctgggcttctgcgacgagcgcctcgtgcccttcgatcacgccgagagcacgtacggcctctaccgggtgagagctacgggggccgccggggatcacgccgagagggccacagccaccgcctacaccccggctacggaggccgccgggggccatgccgaaagggccgcgcccactgtctgcacctcggctacgggggccactgggtatcatgccaagagggccgtgcccactgcctgcacctcggctacgtgggtcgctgggggtcatgccaagagggccgcgcccaccggttgccctcggctacgggggccactgggggtcatgccgagatggtcacgcccactgcctgcacctcgactacgggggccgctgggggtctagccgacagggctcgcccgcctcctgaaccccgcctacagtgggtcccgcaggacctcactgcgccctctgcctttatctaggcagggctagaaatggtctacttgcagtccgtcttcctgcttcatccggtggccaggcagagggaacggcacgggca

SEQ ID NO: 308858 - DNA, 416 bp, Homo sapiens
tcccgggctcaagtgattatcctacctcagcctcccaagtagctaggactacaggtgcctgccaccacgcctggctaatttttgtatttttagtagagacagggtttcatcatgttggccaggctggtcttgaactcctgacctcgtgatccacctacctcggcctcccaaagtgctgggatttcaggtgtgagccaccatgcccagccacagctacttgtatttttttatctgacaactgtttctgtgtcctctgagtctcccctgcccctgccacctacaacctctcaaggctgtcttctccccacgcccaggcattccaaggggactccatcccggttttcgacctgctgatcctgggggtgggccccgatggtcacacctgctcactcttcccagaccaccccctcctacag

SEQ ID NO: 308859 - DNA, 287 bp, Homo sapiens
ctccccatgcctcagtctccccatctgtaaatgagtgttatgacggtactgtcataaactccctggaggatccaggtggtcacgttactgttggtgacattgtccctctgttggctgcagacgcatcttctctccagactgccgatcccagaaagccaggtgatcaccattaaccccgagctgcctgtggaggaggcggctgaggactacgccaagaagctgagacaggtgagccccgaggagcggccgcaagggagtcacatccacgaagcggccacaccccgggc

SEQ ID NO: 308860 - DNA, 775 bp, Homo sapiens
  misc_feature (1)..(1): n is a, c, g, or t
naagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 308861 - DNA, 1103 bp, Homo sapiens
aatgcagttccagtaaccctgtggctttcctgctctgtctgttggtggagggctatcttcactctaagtgtgtcaatggcgtggggccttctggggcatgtccccaggaagtctgtgaggagaccgggacagtcgcaagggcagatgctgccagggacaagtacactgcaacccccctcctgttggacagtgtcctcccaccccgaggccatgggtgggtctatggagaagcagattaccccccgcacaccgagtcttctggggggcgaccagccaaaggtcaatcagccaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 308862 - DNA, 164 bp, Homo sapiens
tgactcatgattcactcacccctgcccggtcctctccctgctccagctccaacgaggaggtcgctgctatgatccgggctggagataccaccaagtttgctattgaaactctaaactaggtgctattgaaacttctaaactaggggtaccagctcgatctattt

SEQ ID NO: 308863 - DNA, 3169 bp, Homo sapiens
aggaggtaggaggaggcatgttgtgcggtgtcgtgggagtggggtgtcagtgttgttgagatgtgtggagagttgggggggttacatgggccaggcttgcagcggcctgttgagcccttggtataggagtctgggtggcctcgctcgcagcccgccagccttccagctagctgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggacgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagaccccgtgggcagcacgcgctgtcccgcctctgagcccggccttgatgctacaacagccagcgagtcccggggctgggaccttgtagacgccgtgacccccggccctcagcccaccctggagcagttggaggagggtggtccccggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 308864 - DNA, 3252 bp, Homo sapiens
aggaggtaggaggaggcatgttgtgcggtgtcgtgggagtggggtgtcagtgttgttgagatgtgtggagagttgggggggttacatgggccaggcttgcagcggcctgttgagcccttggtataggagtctgggtggcctcgctcgcagcccgccagccttccagctagctgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggaggtggggacggggaggggactcagaccggggccgcctgcctggccaccctccggtaccagcctgttgggtggggggttttctagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggacgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagaccccgtgggcagcacgcgctgtcccgcctctgagcccggccttgatgctacaacagccagcgagtcccggggctgggaccttgtagacgccgtgacccccggccctcagcccaccctggagcagttggaggagggtggtccccggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 308865 - DNA, 3112 bp, Homo sapiens
aggaggtaggaggaggcatgttgtgcggtgtcgtgggagtggggtgtcagtgttgttgagatgtgtggagagttgggggggttacatgggccaggcttgcagcggcctgttgagcccttggtataggagtctgggtggcctcgctcgcagcccgccagccttccagctagctgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggacgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagaccccgtgggcagcacgcgctgtcccgcctctgagcccggccttgatgctacaacagccagcgagtcccggggctgggaccttgtagacgccgtgacccccggccctcagcccaccctggagcagttggaggagggtggtccccggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 308866 - DNA, 3596 bp, Homo sapiens
aggaggtaggaggaggcatgttgtgcggtgtcgtgggagtggggtgtcagtgttgttgagatgtgtggagagttgggggggttacatgggccaggcttgcagcggcctgttgagcccttggtataggagtctgggtggcctcgctcgcagcccgccagccttccagctagctgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggacgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagaccccgtgggcagcacgcgctgtcccgcctctgagcccggccttgatgctacaacagccagcgagtcccggggctgggaccttgtagacgccgtgacccccggccctcagcccaccctggagcagttggaggagggtggtccccggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaaggtaactcagggaggggccccgggcaccgtcccacgccagggcgctggcacccagccggtccctccccttccccattgggcactgcaagttccagcggcacccaggagaggtgacttgggtgcggcacgggagaggaggcggcagtgcgtccaccgcagggcggctatgtgggctgccgcggcccgtgcaactattcctccaacctactaattccgaccttcacgccacctccgttagggagtagggggcggacaccgggcaccaggtcccaggcaagtggctgccatgtggcttagtggccagagaaccgggcagccctcagagggtgttggcatggctgtcccgggccccccagccccacccactccgagtcagggttgcttctgtgtgataagccgttgagtgcgtttcttttatttggaagcagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 308867 - DNA, 3282 bp, Homo sapiens
aggaggtaggaggaggcatgttgtgcggtgtcgtgggagtggggtgtcagtgttgttgagatgtgtggagagttgggggggttacatgggccaggcttgcagcggcctgttgagcccttggtataggagtctgggtggcctcgctcgcagcccgccagccttccagctagctgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggacgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctggccctgccctcagtgctgaagcagcagtccagcccgctgggctccagagagatgaggccaggcccactgaccgatgcccttgggctcagagggtgctagaggtggcaggaaagtggccaccagtaaccctgcaggagaccccgtgggcagcacgcgctgtcccgcctctgagcccggccttgatgctacaacagccagcgagtcccggggctgggaccttgtagacgccgtgacccccggccctcagcccaccctggagcagttggaggagggtggtccccggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 308868 - DNA, 2253 bp, Homo sapiens
ggctaggtaacgaggcctggttttgaattggtatagaggctaagtccagacgagaatcctgctgtagcgctgcgtgcaccacgtgtatgtgaggaaggcggaatagagtagccaccccgtatcctccatgcaggctgccccgggtacctggagcagccctcgcaaggcacgtcagggattgatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggacgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagaccccgtgggcagcacgcgctgtcccgcctctgagcccggccttgatgctacaacagccagcgagtcccggggctgggaccttgtagacgccgtgacccccggccctcagcccaccctggagcagttggaggagggtggtccccggcccctggagaggcgttcttcctggtatgtggatgccagcgatgtcctaaccactgaggatccccagtgcccccagcccttggagggggcctggccggtgactctgggagatgctcaggccctgaagcccctcaagttctccagcaaccagccccctgcagccggaagttcaaggcaagatgccaaggatcccacgtccttgctgggcgtcctccaggccgaggccgacagcacaagtgaggggctggaggacgctgtccacagccgtggtgccagaccccctgcagcaggcccaggtggggatgaggacgaggacgaggaggacacggccccagagtccgcactggacacatccctggacaagtccttctccgaggatgcggtgaccgactcctcggggtcgggcacactccccagggcccggggccgggcctcaaaggggaccgggaagcgaaggaagaagcgtccctccaggagccaggaagaggttccccctgattctgatgataataaaacaaagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 308869 - DNA, 837 bp, Homo sapiens
  misc_feature (1)..(1): n is a, c, g, or t
naagaaactgtgtgtgatccagtaaggcctcaggcccaggcccaaggccaagtgagagagcccaggccacaggacatgctgccattctgccaagagaggctcttctgggggccaggctgggactgggccccggaaaccaaaactccgtgccttacccagccggggccctcctggagccttcttggggtgttgtggctgggaacccgacaggcaccagtgccctgccaggcctggtgccctcctggaccgcctgcacgtgccagcctcccacctgcttcctaaaggcaaccctggcccacacccgcatgcgcccggtgcagcctgccaagggccagtcggggggtgctgcgtcctgccagtgtccaccacagctctgcctgcccttcagcccagcaaggtttaatcaaaatgcaatgctttgcaagtctttactgcttggaggtggctgagttgggggccctgggcaggggtaagctggcaggcagtgccatggcaggccagggtcccctcccatggggtctggcccccgttccagcatgtccagcccctgaagttggagtggggggcggtctgcctttgctgccactgccaggcctctgccctgcagctgaaacttggccatcacatcaacagaaaacccctcccagtgccagctgcccagcgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 308870 - DNA, 2135 bp, Homo sapiens
aggaggtaggaggaggcatgttgtgcggtgtcgtgggagtggggtgtcagtgttgttgagatgtgtggagagttgggggggttacatgggccaggcttgcagcggcctgttgagcccttggtataggagtctgggtggcctcgctcgcagcccgccagccttccagctagctgccctgcacctgcagcccccccgtggcgggaggcatggaggaggtcatcgtggcccaggtggaccatggcttgggctcagcatgggtccccagccatcggcgggtgaacccacccacactgcgcatgaagaagctgaactggcagaagctgccatccaacgtggcacgtgagcacaactctatgtgggcgtccctgagcagccccgacgccgaggctgtggagcccgacttctccagcatcgagcgactattctccttccctgcagccaagcccaaggagcccaccatggtggccccccgggccaggaaggagcccaaggagatcactttcctcgatgccaagaagagcctgaacctcaacatcttcctgaagcaatttaagtgctccaacgaggaggtcgctgctatgatccgggctggagataccaccaagtttgatgtggaggttctcaaacaactccttaagctccttcccgagaagcacgagattgaaaacctgcgggcattcacagaggagcgagccaagctggccagcgccgaccacttctacctcctcctgctggccattccctgctaccagctgcgaatcgagtgcatgctgctgtgtgagggcgcggccgccgtgctggacatggtgcggcccaaggcccagctggtgctggctgcctgcgaaagcctgctcaccagccgccagctgcccatcttctgccagctgatcctgagaattgggaacttcctcaactacggcagccacaccggtgacgccgacggcttcaagatcagcacattgctgaagctcacggagaccaagtcccagcagaaccgcgtgacgctgctgcaccacgtgctggaggaagcggaaaagagccaccccgacctcctgcagctgccccgggacctggaacagccctcgcaagcagcagggatcaacctggagatcatccgctcagaggccagctccaacctgaagaagcttctggagaccgagcggaaggtgtctgcctccgtggccgaggtccaggagcagtacaccgagcgcctccaggccagcatctcggccttccgggcactggacgagctgtttgaggccatcgagcagaagcaacgggagctggccgactacctgtgtgaggacgcccagcagctgtccctggaggacacgttcagcaccatgaaggctttccgggaccttttcctccgcgccctgaaggagaacaaggaccggaaggagcaggcggcgaaggcagagaggaggaagcagcagctggcggaggaggaggcgcggcggcctcggggagaggacgggaagcctgtcaggaaggggcccgggaagcaggaggaggtgtgtgtcatcgatgccctgctggctgacatcaggaagggcttccagctgcggaagacagcccggggccgcggggacaccgacgggggcagcaaggcagcctccatggatcccccaagagccacagagcctgtggccaccagtaaccctgcaggagaccccgtgggcagcacgcgctgtcccgcctctgagcccggccttgatgctacaacagccagcgagtcccggggctgggaccttgtagacgccgtgacccccggccctcagcccaccctggagcagttggaggagggtggtccccggcccctggagaggcgttcttcctggtatgtggatgccagcgatgtcctaaccactgaggatccccagtgcccccagcccttggagggggcctggccggtgactctgggagatgctcaggccctgaagcccctcaagttctccacgtgggcaggccctggggacaatacaggtccacctgaggggctgcagggtgacacccagcagccgctgccccctcactgcccacccagcgagggcagcctacccgagcctgccccctgccaggtgtgtgccctgaggctggcggctggatgcgtggccaataaaaagcagacctag

SEQ ID NO: 308871 - DNA, 4798 bp, Homo sapiens
atggaacactgagacaccgacggaatgctccgaatcgcccccgccgcccaccctgtacgtgcagctccacggagagaccacccggcgcttggaggcggaggagaagccattgcagatccaaaatgactacctcttccaactgggatttggggagctgtggagggtgcaggaggaaggcatggactcggagattggctgcctcatccgcttctatgcaggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttccctctggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatgacccagccgagctgtttaacaaataaactaaccacaaaagactgagttgcaagagtctcccaggctcacattaaaccaggggttttactccacatccttcccccagacactgttcccaacctgtcatcgcagctaatctgtaggttctctttctttgggttatttttttaagtaatcaccactttcttctagtgatgctttaccaatatgatttacatttgttaacttctccccctaacatatcagatatgtaaagacaaagaacaaaaggtttaatatattacagagaaacagttaatgataatgtaatattttttaaaatggctttttgttgtttgtttggaaggcagggcaggctgccgttgctaaatgatttaataatattgtaattctgtatttctttggggggaaaaggcttttgttttgttttgttttgttttgttttgtttttgtcttgaaaataatagacatttgtagaatatggagactaactcctaggagttgctttactctgtcaggtgacttaagtcactgggattcactaattttctctgagagaacagctgattgagaatttccattgtaaatagctcagtgttgtatagtgaggcttacgatgttttgtagtcttggcgtaaggacacagcccaagtaactgacgtttcccctccccctcccctctgaggagcctgcctgcctcacaactcaccctcacttcactgaatgaggaggctgagcagctgcagtgtttctgtccggaggaaatggatcttaggccactggacaagaacctgcacccaagggccctgaacccattttcctcccctgtcccagccttcccactttgacagacacttttaactgtgttccttactgctgccacaatcagcatggttgtatagtgccccattaggccatttacatacccagagttatactcaagcagaatgcacaaatggacatgtcataatttttgttacaataaatatgaaatttacaagta

SEQ ID NO: 308872 - DNA, 4677 bp, Homo sapiens
cagaaatactaacatagctaaataaccctgcctgcctttgaagagcttatgattttgtatcagaagatgaagtaggcacaatgatatctgttgtaagaaagatgcaggaaggtactgtgggggattaatggaaggagagattacattttttcgggtagaagaagtgaaaaagcaccaacactgtttagcatttagctcctctggaccccaaagccagacttactacatttgctttgatactttcacagaatacttaaggtggctgcgacaagtctccaagcatctagggagagtagactagaatctcgctccatttgggaatatatgcctacagggaatttgacatggataaggatgattgttacaagctccttcagcttccagtttcccccttcaattgtcatctgctcttcttcctatgttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttccctctggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatgacccagccgagctgtttaacaaataaactaaccacaaaagactgagttgcaagagtctcccaggctcacattaaaccaggggttttactccacatccttcccccagacactgttcccaacctgtcatcgcagctaatctgtaggttctctttctttgggttatttttttaagtaatcaccactttcttctagtgatgctttaccaatatgatttacatttgttaacttctccccctaacatatcagatatgtaaagacaaagaacaaaaggtttaatatattacagagaaacagttaatgataatgtaatattttttaaaatggctttttgttgtttgtttggaaggcagggcaggctgccgttgctaaatgatttaataatattgtaattctgtatttctttggggggaaaaggcttttgttttgttttgttttgttttgttttgtttttgtcttgaaaataatagacatttgtagaatatggagactaactcctaggagttgctttactctgtcaggtgacttaagtcactgggattcactaattttctctgagagaacagctgattgagaatttccattgtaaatagctcagtgttgtatagtgaggcttacgatgttttgtagtcttggcgtaaggacacagcccaagtaactgacgtttcccctccccctcccctctgaggagcctgcctgcctcacaactcaccctcacttcactgaatgaggaggctgagcagctgcagtgtttctgtccggaggaaatggatcttaggccactggacaagaacctgcacccaagggccctgaacccattttcctcccctgtcccagccttcccactttgacagacacttttaactgtgttccttactgctgccacaatcagcatggttgtatagtgccccattaggccatttacatacccagagttatactcaagcagaatgcacaaatggacatgtcataatttttgttacaataaatatgaaatttacaagta

SEQ ID NO: 308873 - DNA, 5261 bp, Homo sapiens
  misc_feature (4807)..(4807): n is a, c, g, or t
  misc_feature (5174)..(5174): n is a, c, g, or t
  misc_feature (5214)..(5214): n is a, c, g, or t
  misc_feature (5220)..(5220): n is a, c, g, or t
  misc_feature (5261)..(5261): n is a, c, g, or t
atggaacactgagacaccgacggaatgctccgaatcgcccccgccgcccaccctgtacgtgcagctccacggagagaccacccggcgcttggaggcggaggagaagccattgcagatccaaaatgactacctcttccaactgggatttggggagctgtggagggtgcaggaggaaggcatggactcggagattggctgcctcatccgcttctatgcaggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttccctctggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatgacccagccgagctgtttaacaaataaactaaccacaaaagactgagttgcaagagtctcccaggctcacattaaaccaggggttttactccacatccttcccccagacactgttcccaacctgtcatcgcagctaatctgtaggttctctttctttgggttatttttttaagtaatcaccactttcttctagtgatgctttaccaatatgatttacatttgttaacttctccccctaacatatcagatatgtaaagacaaagaacaaaaggtttaatatattacagagaaacagttaatgataatgtaatattttttaaaatggctttttgttgtttgtttggaaggcagggcaggctgccgttgctaaatgatttaataatattgtaattctgtatttctttggggggaaaaggcttttgttttgttttgttttgttttgttttgtttttgtcttgaaaataatagacatttgtagaatatggagactaactcctaggagttgctttactctgtcaggtgacttaagtcactgggattcactaattttctctgagagaacagctgattgagaatttccattgtaaatagctcagtgttgtatagtgaggcttacgatgttttgtagtcttggcgtaaggacacagcccaagtaactgacgtttcccctccccctcccctctgaggagcctgcctgcctcacaactcaccctcacttcactgaatgaggaggctgagcagctgcagtgtttctgtccggaggaaatggatcttaggccactggacaagaacctgcacccaagggccctgaacccattttcctcccctgtcccagccttcccactttgacagacacttttaactgtgttccttactgctgccacaatcagcatggttgtatagtgccccattaggccatttacatacccagagttatactcaagcagaatgcacaaatggacatgtcataatttttgttacaataaatatgaaatttacaagtaaaaaaaaanaaaaaaaaaacaaaaaaaaaaatttgtgtggggccgccccggcgccccagaaaaaaagttttttaaaccccattcgtgttggggccgccgcgggccccccgatgttggttttagtggaacccgtgggccccaagggcggttccccagaggagaacaccgcggcgttgcaggaacgagagggctgtggcgtttctctccccaatataaaaaaagaagcaccgcgcgggcgaacgacacgcgaacggcggtttttgtggaacaaacatctccgcagagtgggaggagttcgcgagcgggatccaccaaccggggtagtctcctcacacaaccagagaggacggtctcgccgagcggacgaccggccgantatatcaccagaatttcaggccgcggccccggcgcggggnaggagncacacacaacaacgagccacaacgatccaacagcactacgn

SEQ ID NO: 308874 - DNA, 2874 bp, Homo sapiens
tacccgaatttatatgctcactgctcaacagcatcatgattttcttgacatcagcattaattgagctaaataaagtcgctttacctcaacaacagtctccctgactgcatgagctctacctaactgcaatcctgcgcctatcttcttgattggaaaacccttgcggtactgaataatatccgctgtttcaagattgatcagccttctacaggagacgcttccggagccccagctgtatggagtcatggttacactgaagcttcgggggtaaaaaacaagttgtgtgtcgcagccctgtcggtgaataacttctgtgacaaccgcgaagccctgtatggtgtgtttgacggagaccggaatgtggaggtgccctaccttctccagtgcactatgagtgacattttggctgaagagctgcaaaaaacaaaaaacgaagaagaatacatggtcaatacattcattgtcatgcaaaggaaacttggaactgctgggcagaagcttggtggtgccgctgtcctttgtcatatcaagcatgaccctgtggatccaggaggatccttcaccttgacctctgctaatgtgggcaagtgccaaacagttctctgtcgaaatggaaagccgctgcctctgtccagatcttacatcatgagctgtgaagaagagctgaagaggattaaacagcacaaggccattatcactgaggatggcaaggtgaacggagtgactgagtccacgcgcatcctgggctacaccttcctccatcccagtgtggtgcctcgcccccacgtgcagtccgtgctcctgactccccaggatgagttcttcatcctaggcagtaaggggttgtgggacagcctgtccgtcgaggaggccgtggaagccgtgcgcaacgtgcccgatgccctggctgctgccaagaagctgtgtaccctggcccagagctacggctgccacgacagcatcagcgctgtggtggtgcagctcagtgtcactgaggacagcttctgctgctgcgagctcagcgccggtggggctgtgccaccacccagtcctggcatctttcctccctcagtgaacatggtgatcaaggatcggccctcagatgggctgggcgtgccgtcctccagcagcggcatggcttccgagattagcagtgagctctccacttctgagatgagcagcgaggtggggtcaacagcctccgatgagcccccgcccggagccctaagcgagaacagccctgcctaccccagtgagcagcgctgcatgctccaccccatctgtctgtccaactccttccagcgccagctatccagcgccacgttctctagcgccttctccgacaacggccttgacagtgacgatgaggagcccatcgagggcgtcttcaccaacggcagccgggtggaggtggaggtggacatccactgcagccgggccaaggagaaggagaaacagcagcacctgcttcaggtgccagcagaggccagtgatgagggcattgtcatcagcgccaacgaggatgagccaggtctgcccaggaaggcagacttctctgccgttgggaccattgggcgccggagggccaatggctctgttgcgccccaggaaaggagccacaatgtgatagaggtggctacagacgcacctcttcgaaagcctggaggctattttgctgccccggctcagccggatcctgatgatcagtttatcatacccccggagctggaagaggaggtcaaagaaatcatgaagcatcaccaggagcaacagcagcagcagcagccgccaccaccccctcagctccagccgcagctgccgcggcactaccagctggaccagctgccagattattacgacacgccactatgacccagccgagctgtttaacaaataaactaaccacaaaagactgagttgcaagagtctcccaggctcacattaaaccaggggttttactccacatccttcccccagacactgttcccaacctgtcatcgcagctaatctgtaggttctctttctttgggttatttttttaagtaatcaccactttcttctagtgatgctttaccaatatgatttacatttgttaacttctccccctaacatatcagatatgtaaagacaaagaacaaaaggtttaatatattacagagaaacagttaatgataatgtaatattttttaaaatggctttttgttgtttgtttggaaggcagggcaggctgccgttgctaaatgatttaataatattgtaattctgtatttctttggggggaaaaggcttttgttttgttttgttttgttttgttttgtttttgtcttgaaaataatagacatttgtagaatatggagactaactcctaggagttgctttactctgtcaggtgacttaagtcactgggattcactaattttctctgagagaacagctgattgagaatttccattgtaaatagctcagtgttgtatagtgaggcttacgatgttttgtagtcttggcgtaaggacacagcccaagtaactgacgtttcccctccccctcccctctgaggagcctgcctgcctcacaactcaccctcacttcactgaatgaggaggctgagcagctgcagtgtttctgtccggaggaaatggatcttaggccactggacaagaacctgcacccaagggccctgaacccattttcctcccctgtcccagccttcccactttgacagacacttttaactgtgttccttactgctgccacaatcagcatggttgtatagtgccccattaggccatttacatacccagagttatactcaagcagaatgcacaaatggacatgtcataatttttgttacaataaatatgaaatttacaagta

SEQ ID NO: 308875 - DNA, 2339 bp, Homo sapiens
atggaacactgagacaccgacggaatgctccgaatcgcccccgccgcccaccctgtacgtgcagctccacggagagaccacccggcgcttggaggcggaggagaagccattgcagatccaaaatgactacctcttccaactgggatttggggagctgtggagggtgcaggaggaaggcatggactcggagattggctgcctcatccgcttctatgcaggaaaacctcacagcacgggtagctctgaacggattcagctctcaggaatgtataatgtccgtaaaggcaagatgcagttgccagtgaaccgatggacaagacgccaagtcatcctatgtgggacctgcctgatagtatcatctgtgaaagacagcttgaccggaaagatgcatgttctgccactaattggtggaaaagtagaagaagtgaaaaagcaccaacactgtttagcatttagctcctctggaccccaaagccagacttactacatttgctttgatactttcacagaatacttaaggtggctgcgacaagtctccaaggttgcatcccagcgcattagctcagtggacctctcgtgttgtagcctggaacatctgcctgccaacctcttctacagccaagacctcactcatctcaatttaaaacaaaacttcctaaggcagaaccctagccttccagctgccagggggcttaatgaactgcaaaggttcaccaagttgaagagtcttaacctttccaataatcatttaggggacttccctctggcagtctgcagtattccaaccctggcagagctgaacgtgtcctgcaatgccctgcgatcagtcccggcagccgttggagtgatgcacaacttacagacatttttgttggatggaaactttctccaatcccttcctgctgagttggagaacatgaagcagcttagttatctgggtctttctttcaatgaatttactgacattcccgaagtattggagaaattgactgctgtggataaactttgtatgtctggaaactgtgtggagacccttaggctacaggctttaagaaaaatgcctcacattaaacatgtggatctaaggttgaacgtaattaggaagctgatagcagatgaagtggactttctacagcatgttactcagcttgacctacgagacaataagcttggtgatctagatgctatgattttcaacaacattgaagttttacactgtgaaaggaatcaactggtcacattagacatctgtggctatttcctaaaagcgctctatgcctcttctaatgaacttgttcaacttgatgtttacccagttccaaattatctgtcctacatggatgtttcaaggaaccgcttagaaaatgtgcctgagtgggtatgtgaaagccgaaagctagaagttttggatattggccataatcaaatatgtgaacttcctgcccgcttattttgtaatagcagtctccggaaactactggcaggacacaaccagttggcaaggctgcctgaaaggctagaaagaacctcggtggaggtcttggatgtgcaacacaaccagctccttgagctcccacctaaccttctgatgaaggctgacagcctgagattcctgaacgcctctgcgaacaaactggaaagccttcctccagccacgctttccgaagagacaaacagtatcttacaagagttgtatttgacaaataacagcctcacagacaaatgtgtgcccttgttaacgggacacccccatttgaagatccttcacatggcctataaccgacttcagagttttccagcaagtaaaatggcgaaactggaggaacttgaagaaattgatctcagtgggaataagctgaaagccatcccaacaacgatcatgaattgcaggcgcatgcacaccgtgattgctcactccaactgcatcgaggtctttcccgaagttatgcagctcccagagatcaagtgtgtggacctgagctgtaatgagctaagtgaagtcacattaccagaaaacctgcctcccaaactgcaggagctagacctgactggaaacccgcgccttgtccttgatcacaaaaccctggaactactgaataatatccgctgtttcaagattgatcagccttctacaggagacgcttccggagccccagctgtatggagtcatggttacactgaagcttcgggggtaaaaaacaaaaagatcgaggggccccatcccctttcggaagaaaaaacatatggtgacaaaccccggaaagcccctgaacgggggggtttgacgggagacacggaaaggggggggggggccctaaccttttctccagtgggcccta

SEQ ID NO: 308876 - DNA, 106 bp, Homo sapiens
atgcaggaaggtactgtgggggattaatggaaggagagattacattttttcgggtaagagggaattttgtaatgaaaggtagcaattatgatagaatttgaaggat

SEQ ID NO: 308877 - DNA, 1100 bp, Homo sapiens
aaatggatgcagtaaggtcactgaagtcaaaaagttaacataaagtttggcaggtagccactagaccagtttgtttggcatagtatttggggtgacaaagttggtgcaatgtatcataaagtggggaaggacccttggggcactaggatttgtttcttactttctttttttttttttttgagacggagtctctgttgcccaggctggagcgcaatggcgcaatcttggctcactgcaacctctgcctcctgggttcacccatttcacctgcctcagcctcccaagtagctgggattataggcacccgccaccatgcctggctaatatttttagtagagacggagtttcaccatgttggtcaggctcgtcttgaactcatgactttaagcaatccacctgcctcggcctcccaaagtgctgggattacaggcgtgagccactatgcccagctagatctcattttaaaatatgaaagacctttagatgttcatttatatttgtttctgttctaggctctgtacaaaatgagctaagtagctaaggtatgtgcattccaggtcatctgtcttagataatcatacagaaaggaaatcatagactttacagtatatattaaataactaccagttgacttgctaatgaaagggaaagtttgtatgaatttaaaactctagaccagcactgtttaacagaactctctgtaataataggaatgttctatacctgggatgtccagtgtggtaactgccgccacgtgtatctgttgaatgcttgaaatgtggctaacgtcactacggaactgaattttttatttttttatttttttgagacggagtcttgctctgtcacccaggctggagtgcagtggtgcaatcttggctcatggtaacctccgcctcccggattcaagcaattctcctgctgcagtctcccaagtagctgggactataggtgcacgctgccacacccagctaattttttgtgtttagtagagacgaggtttcaccatgttgcccaggctggttgcaaactcctgagctcaggcaatccgcatgcctctgcctcccagagtgctgggattaccggcatgagccaccatg

SEQ ID NO: 308878 - DNA, 484 bp, Homo sapiens
aaatagatgtttatcattttttatatagactcattgaaaaaatgactttgtgttcttccagtacataccatcatgtctgagagggcagagatctagacaagtgtgggaaagatgactttggatcaaaattttcttgtgaatataatgtgcttatgcgtaatttaaagctgactgtattaaagatacattttttgtcaaccagatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacagatctgtgccactgcactccagcccgggcaacagagcaagactccgtctca

SEQ ID NO: 308879 - DNA, 5510 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308880 - DNA, 5605 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacagggtctcactctgtcacccagactgcagtgcagtggcacgatctcggctcactacaagccttgacctccaggactcagtctccttgtggaccaccacccttctgttatgacattgccacattgccacagattgatgcttacacaccatctcttttggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308881 - DNA, 5813 bp, Homo sapiens
aaatggatgcagtaaggtcactgaagtcaaaaagttaacataaagtttggcaggtagccactagaccagtttgtttggcatagtatttggggtgacaaagttggtgcaatgtatcataaagtggggaaggacccttggggcactaggatttgtttcttactttctttttttttttttttgagacggagtctctgttgcccaggctggagcgcaatggcgcaatcttggctcactgcaacctctgcctcctgggttcacccatttcacctgcctcagcctcccaagtagctgggattataggcacccgccaccatgcctggctaatatttttagtagagacggagtttcaccatgttggtcaggctcgtcttgaactcatgactttaagcaatccacctgcctcggcctcccaaagtgctgggattacaggcgtgagccactatgcccagctagatctcattttaaaatatgaaagacctttagatgttcatttatatttgtttctgttctaggctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacagggtctcactctgtcacccagactgcagtgcagtggcacgatctcggctcactacaagccttgacctccaggactcagtctccttgtggaccaccacccttctgttatgacattgccacattgccacagattgatgcttacacaccatctcttttggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308882 - DNA, 5305 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagcacagtttgctgcttttctgaaacaaaatatgctggtgaggaaagctcttcctcctggcacctcctcctgtctctttgttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308883 - DNA, 5480 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308884 - DNA, 4922 bp, Homo sapiens
cgtggaggcgttaacgcgcacgcgcttagggatccggccgtggccgagcgcgcggccgtaagaccgcgggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308885 - DNA, 5441 bp, Homo sapiens
aatatgtcgtctgttcagtggtgctgtgcgtttatttatgattggaataattttagctactaagtaagtaattagctttgctagcctgaaagacttttttcatgactagtcttgacttgtactgtgtatattattgtgtgtatgtgtgtattattaatacaagtgtgtgctgtgacgatttgatttggtaggattgagaccagaagaatctaggtcttgtgttttaggtcagtggtcttagactaagctacttcgttttactgttccctagcagagacataaaactatggcataatcttctttatatggtgtacatacatggggagcgtccccagggtttgactataattcctcagagtttcccttataggactggctggacaatggcccagaacaagctattcaacaagatcctcaaagccctgcagtctgaccggcttgcccgcttggccaacgaaggggtaagacaccagcaatccgcccacagtgggctcttcgtagttcaggcctcactggctgactgacttgtccccctgcttgttaaccaggtagtcctcatgttttattacttccacttacatccttcaggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308886 - DNA, 5637 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggtaagacaccagcaatccgcccacagtgggctcttcgtagttcaggcctcactggctgactgacttgtccccctgcttgttaaccaggtagtcctcatgttttattacttccacttacatccttcaggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308887 - DNA, 5378 bp, Homo sapiens
aaatagatgtttatcattttttatatagactcattgaaaaaatgactttgtgttcttccagtacataccatcatgtctgagagggcagagatctagacaagtgtgggaaagatgactttggatcaaaattttcttgtgaatataatgtgcttatgcgtaatttaaagctgactgtattaaagatacattttttgtcaaccagatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308888 - DNA, 5363 bp, Homo sapiens
cctcgtcgcgaactctggatgaccttggccaaatcgcttcagttccccgagctggcgacttcgtctgtaaaatgtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308889 - DNA, 5173 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308890 - DNA, 3492 bp, Homo sapiens
gctagtagagccgggatcaaatcggacgaggcttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308891 - DNA, 3385 bp, Homo sapiens
ggacggtgggtcgacccacgcgtcgggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308892 - DNA, 5517 bp, Homo sapiens
  misc_feature (3389)..(3389): n is a, c, g, or t
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttaggaaaaaccagcgttccagggaaattaaccgttgggncaggtttaaggccccttttggccctttggaaactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308893 - DNA, 5271 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcgcctgcctccagcaccctgaagatgctgtgtgatatgtcctccttaccaagttggtgatggctgcctcatggtgggccctggacaggtgtgtggtcctgctgagctgtccacgtgtcggaagacctgtttaagacagtcatttttgcctctccgccaactgtcttcagagaaaccattaggttaggtgatacggtgccagcaagggaagcaccatcgtccaggatctgcaaatctggttcctgggaaccccagactcctcagcagatctggctgtacatggatcagaaccacttcttcccccgcttaagctgtggtttgacccaagggtcagcatataggactgcctgctgcatttaatgaaggtgtttccttttggaagtctgtgctaccctctgcgcctagttgggaggagacatccatctggtctgggatttcgggagttagaatggaaagctctttgctaaagactggagtcatcctggcctgccaactggtggttcagagccggacgggcttgttttggacatcactgttgccttcactcagcagccacgggagagtgctccccatgcaactccaccttagaaaccacgtcagatactgagtagcttgctgactcctggaaacttctggtttttgttagtatcataatgaaggcaaagagaactaggctgtcatctttcagcctctttgacttactctagatgttgggagcagtggttgccaggtgaaacctgggccctttgtctttttcaccatgctttgggcagtttctgtatccagagagtccgcaggttcagataagctgaagaagagtaatagaacagcaaaggaagtggcttgaaggatgtgctagtaagccctgtggtttgtgcttaggtctctgctctgctacccaaggaactggtggttcagctggagataaaaagaagaatttgccaagtcagagaagaaaccccaaccccggaaaatcctctgtctccagtctctggaggtgaagcagggacaataagctaaggtagtatcttggccatcccaggaaacttgtggcattaggacgatgaaggccatgcttcagtgttttcgtttctatttcatgagactttttgtcttcctgcttacaagtgggaagatgattgacagtgactctactatgcagggctgttggtaccaacctgagccctataggtggcagtccctggagaagtggtcacagaagatggagctctgatcccctgcttacctcttcacaacacttgtgtgcaaagatagttttagatttggtttagaagctatcctccagaacaggctcccatacttagaatgtttctagttaaggtaataaattaggcaacccaagtgtgactccactcaagtgtccttttctgtaggcaggaagggcccacaacatggcttaaaatgtagtccatggttctggcccacagtacagtgtgtatctataccaggtcacctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaaccccgagtctaataaaacgtataatcacaaaaaaaaaaaaaaaaaaaaaaaaaaaaaaaaaaaaaaaatacaaaaaaaaaaaaaaaaaaaaaaaaagcaaaaaaaaaaaaaaaaaacaccaccacagaagggcggccataaacatctccctgtcccacaccaccacagaacacgcggctggcaaaaaacaagaaacggcgtccacaggacgctgccataatcaaactatgcagcggaggacgccaattacccgaaaggcccctctgcgacgaacaacccaccacggggacatcgcccgagcccccaccccggcgacgaacacaagcggagcaaccacccacgaacagcccaccgacggcacaaaaccaccgtcgttggaaaacgagcagagcggcgaccatccg

SEQ ID NO: 308894 - DNA, 1275 bp, Homo sapiens
tgcttagtcgaggccgggcgtgaatcggccgaggctgtgttcaatctgggagccttcctggccagtctgagtggcagccagaagggagctcatagtgtctaggagtctcaggcaaggtaggtcagggtactgtgggcaggggggatgtgtgtgataggagagggtaccctaaaccccataccttccctccctgacctgaaaagctgatctcaacagggattcacacagaattaggctgtgtttttgcattagctggtaggtgactttctcaaaattcttaaattcagaaagtatttagtaaacttgaggaaggtatgaaatctggaggaggcatccaggacccaggggtttgatagctttacaggtaggatcataccacaccaaaagagcagtggacaataagactatatgagctatatgaagcttttaggaatcatttaggacagacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308895 - DNA, 858 bp, Homo sapiens
agcccggctccaattccattccagcgtacacagagccctaaacaacccattcatgacttaagttgttggctcagtgtatgctggggacaaagaaaaactaacaagccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308896 - DNA, 801 bp, Homo sapiens
gtctgtggtcacgtggtctgtctgtgtgacaacgatcgatgaatgggaccgacctgcctttatgataaattctagtgtgcttacaagggatgacttcctgaggtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308897 - DNA, 5132 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacaggtgagtctgccaggaaggactgaggacatgggcttcattattgggaagtttaagaccagctgactggctgattgaaggggctgcccatgcactggacagacgagattcagattcaaattcaaatctgtattctggagtttgtggctttataatattgagcgaatcatggacatctttgagcttcctcttctacatccctcccttgatattgtgaagagtacatatgttcaagtgggtagcagtgtctagtatttaatgtttttgtttacttttcctttcgtttcatttttttctcatccttggtttcatccttcagaggttatgagtagaggctacttggctaatgctctttctttgtttttatttttattttttgagatggagtcttgctctatcgcccaagctggagtgcaggggtgtgatctcggctccctgcaacctccacctccccggttcaagcaattctcctgcctcagcctcccaagtaactgggattacaggcgcccgccaccatgcccggctacaacagggtttcactgtgttgaccaggctggcctcgtactcctgacctcaagtgatctacttgtctcggcctctgaaagtgctgggattacaggtgtgagccaccgctcctggccctttctttgtttttaaggacatggagacagagatatctcactatgttgcccaagctggccttgaactccaaggtttaagtggtcctcccgcctcggcccccaagtataatactctttctttgacattggctttctagcactgtgccttcccatatcttagcatttattgctgtctttttagggcacagctaggtttttataggtctcacccaggaagtcatgattagtttctcttagctgatctaatttcccctgtgaccttttcaagtcaaatatttctaatcttaaaatggtaatctgaggagccactcaaagattagaagttaagccaaaaaacagtttgagtctagtactgagtgtgctttccttcagtatccgctatacagccaaggccttcctgtgtctccctgtcctttccaccatgtcaacctgcttgtgaactggaggtgcagtgatagttcctgagccattctaaaagctcttctgtctcttcctctttagggaaaatactgcacagaggtcaacacctgacattcgttgggatcatagctacctttttttgcagagggatggaaatgttttaattttatcttatttcttattttttcaattataaaaatgattatgcttattttaaataattcaaacattatagaaataattaatttagaaagggaaagtttcccatgatgctactcctagagatgatgttcactgttaatagcctgatatggatccattcaaatttttttttctacacaaagtatgttattttatttattttgtacaaatatgggattacagagtatggactgttttgtaacttgcctttttttataaatcatgtcgtgacacgtttccctgtctgtgtcttttcagaggctggctagtatttcactgagtagatgtatgaagatgtatttcaccaccttctgttaggtagatagctgggttctattttggtttttgatattttaaataatgctctggtgaacacttgtttattcttgtgtacctctgggagcatttctccaggccagagaataagtagaggatgtgtacctctaatatctgggcagctgctcactaactgcccttcaaaaagtttttgctactttacaattctagccacggtgatgaaaatatgtttcatattttgtggaaatcaaaattttaactttattaatctgggtgaaaaatgaaattgttttaatgtgcattttcctgattacttaagaagttttatgtcttttatgaaatgtttgtcatactctttgaattatagtggctttgtatattcagatgttaaatctttatctgttacacaaattacatatatgttattcctgtcaaaaaaaaaaaaaaaaaaaaaaaaaaaaaaaaaaaaaaaaatacaaaaaaaaaaaaaaaaaaaaaaaaagcaaaaaaaaaaaaaaaaaacaccaccacagaagggcggccataaacatctccctgtcccacaccaccacagaacacgcggctggcaaaaaacaagaaacggcgtccacaggacgctgccataatcaaactatgcagcggaggacgccaattacccgaaaggcccctctgcgacgaacaacccaccacggggacatcgcccgagcccccaccccggcgacgaacacaagcggagcaaccacccacgaacagcccaccgacggcacaaaaccaccgtcgttggaaaacgagcagagcggcgaccatccg

SEQ ID NO: 308898 - DNA, 5061 bp, Homo sapiens
  misc_feature (5056)..(5056): n is a, c, g, or t
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacaggtgagtctgccaggaaggactgaggacatgggcttcattattgggaagtttaagaccagctgactggctgattgaaggggctgcccatgcactggacagacgagattcagattcaaattcaaatctgtattctggagtttgtggctttataatattgagcgaatcatggacatctttgagcttcctcttctacatccctcccttgatattgtgaagagtacatatgttcaagtgggtagcagtgtctagtatttaatgtttttgtttacttttcctttcgtttcatttttttctcatccttggtttcatccttcagaggttatgagtagaggctacttggctaatgctctttctttgtttttatttttattttttgagatggagtcttgctctatcgcccaagctggagtgcaggggtgtgatctcggctccctgcaacctccacctccccggttcaagcaattctcctgcctcagcctcccaagtaactgggattacaggcgcccgccaccatgcccggctacaacagggtttcactgtgttgaccaggctggcctcgtactcctgacctcaagtgatctacttgtctcggcctctgaaagtgctgggattacaggtgtgagccaccgctcctggccctttctttgtttttaaggacatggagacagagatatctcactatgttgcccaagctggccttgaactccaaggtttaagtggtcctcccgcctcggcccccaagtataatactctttctttgacattggctttctagcactgtgccttcccatatcttagcatttattgctgtctttttagggcacagctaggtttttataggtctcacccaggaagtcatgattagtttctcttagctgatctaatttcccctgtgaccttttcaagtcaaatatttctaatcttaaaatggtaatctgaggagccactcaaagattagaagttaagccaaaaaacagtttgagtctagtactgagtgtgctttccttcagtatccgctatacagccaaggccttcctgtgtctccctgtcctttccaccatgtcaacctgcttgtgaactggaggtgcagtgatagttcctgagccattctaaaagctcttctgtctcttcctctttagggaaaatactgcacagaggtcaacacctgacattcgttgggatcatagctacctttttttgcagagggatggaaatgttttaattttatcttatttcttattttttcaattataaaaatgattatgcttattttaaataattcaaacattatagaaataattaatttagaaagggaaagtttcccatgatgctactcctagagatgatgttcactgttaatagcctgatatggatccattcaaatttttttttctacacaaagtatgttattttatttattttgtacaaatatgggattacagagtatggactgttttgtaacttgcctttttttataaatcatgtcgtgacacgtttccctgtctgtgtcttttcagaggctggctagtatttcactgagtagatgtatgaagatgtatttcaccaccttctgttaggtagatagctgggttctattttggtttttgatattttaaataatgctctggtgaacacttgtttattcttgtgtacctctgggagcatttctccaggccagagaataagtagaggatgtgtacctctaatatctgggcagctgctcactaactgcccttcaaaaagtttttgctactttacaattctagccacggtgatgaaaatatgtttcatattttgtggaaatcaaaattttaactttattaatctgggtgaaaaatgaaattgttttaatgtgcattttcctgattacttaagaagttttatgtcttttatgaaatgtttgtcatactctttgaattatagtggctttgtatattcagatgttaaatctttatctgttacacaaattacatatatgttattcctgtcaaaaaaaaaataaaataaaataaacccttttcctttaagagaacctttcttatggctttgaggctacttccttacggcttggatggtgtgaggcgaagtgaaagtgggatatttataattcttgtggcttaaaaagttcttccctggaaagaaaggaacaaacttggatttctcaaaatggtctaaaatgtatgactgatggtttgcagcaggtgcagagcaagtccggggcagtgtctggcacagtatctttcctgtgtgggatccattgcgtgtgtgcctagttggggagagcttctgncttct

SEQ ID NO: 308899 - DNA, 724 bp, Homo sapiens
caacgatggtcctcagctacttcctgtgtgatctgtccaccttgaagaactccacaactgaagaaggggagctgtgagaacgtggattgttctacaacttgcacagggtaacagaggaagtggctgaggcctagagtcacgttttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308900 - DNA, 2247 bp, Homo sapiens
aaatagatgtttatcattttttatatagactcattgaaaaaatgactttgtgttcttccagtacataccatcatgtctgagagggcagagatctagacaagtgtgggaaagatgactttggatcaaaattttcttgtgaatataatgtgcttatgcgtaatttaaagctgactgtattaaagatacattttttgtcaaccagatgattgttaaatacctgtgaagtatgtgtggcccggtcctatttcctcacctgtttacagtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308901 - DNA, 2344 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacttccagttcccttcgcaaactatatttcttggaacgcgaaaggaagctttacctatttcatagaagacctggaatccataacctcagaaggcaatattattgatagaaaatgtggaaggatcaggaagttcttagattcttggatgacagatgcatgttgatgccctatggagatgtccttgtgttttgaggtcactgaggtaggaagacctgtctactcttggtttcaccactagaacagtcttgggctggatgggttatagagctgagcggctgtgatggttctgtttttacattaacaaaaacaattaaaaacaccaaaaacaaaaagccatgggcagacccacggtctgacattgattgaggcgcggaaataccttcacaaaggggggggccgcgagaaacaccgcggtctcactgtaatagtcccccgttgcgtgtgaaatagtcgtgccccccagatacagccacttgtagtctgtgcaagccagggggttacaaaaaggcggggggccaccccctatcagggaggggacgagttgtatctttttccgccaatgccgcggggtgaacgcgaactc

SEQ ID NO: 308902 - DNA, 3993 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagggaaaatactgcacagaggtcaacacctgacattcgttgggatcatagctacctttttttgcagagggatggaaatgttttaattttatcttatttcttattttttcaattataaaaatgattatgcttattttaaataattcaaacattatagaaataattaatttagaaagggaaagtttcccatgatgctactcctagagatgatgttcactgttaatagcctgatatggatccattcaaatttttttttctacacaaagtatgttattttatttattttgtacaaatatgggattacagagtatggactgttttgtaacttgcctttttttataaatcatgtcgtgacacgtttccctgtctgtgtcttttcagaggctggctagtatttcactgagtagatgtatgaagatgtatttcaccaccttctgttaggtagatagctgggttctattttggtttttgatattttaaataatgctctggtgaacacttgtttattcttgtgtacctctgggagcatttctccaggccagagaataagtagaggatgtgtacctctaatatctgggcagctgctcactaactgcccttcaaaaagtttttgctactttacaattctagccacggtgatgaaaatatgtttcatattttgtggaaatcaaaattttaactttattaatctgggtgaaaaatgaaattgttttaatgtgcattttcctgattacttaagaagttttatgtcttttatgaaatgtttgtcatactctttgaattatagtggctttgtatattcagatgttaaatctttatctgttacacaaattacatatatgttattcctgtcaaaaaaaaaaaaaaaaaaaaaaaaaaaaaaaaaaaaaaaaatacaaaaaaaaaaaaaaaaaaaaaaaaagcaaaaaaaaaaaaaaaaaacaccaccacagaagggcggccataaacatctccctgtcccacaccaccacagaacacgcggctggcaaaaaacaagaaacggcgtccacaggacgctgccataatcaaactatgcagcggaggacgccaattacccgaaaggcccctctgcgacgaacaacccaccacggggacatcgcccgagcccccaccccggcgacgaacacaagcggagcaaccacccacgaacagcccaccgacggcacaaaaccaccgtcgttggaaaacgagcagagcggcgaccatccg

SEQ ID NO: 308903 - DNA, 3150 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcaacatggatgaacttggaggacatgttaagtgaagtaagtctggacagaaaaatactgcgtgttctcacccacaggtaggagctaaaaaagctgatcttatagaagtagggagtgtaggtgggatgaataacttctagtgttctataacactataggctgactataattaacaatttattatagattttcaaattcctagaaaaccagattttgaatgttcccaggataaagaaatgagaaatgttttgaggtgctggatatgccaattatcctgatttgatcattacacattgtatacacgctttgaaatattgtactctgccccataaatacatacaattatatgccagttaaaaataataaaagctggccgagtgcagtg

SEQ ID NO: 308904 - DNA, 3004 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggggccacatcagccagcagcctcctccaaggcctcagcttcagcttgcaggatatcagcagcaagacctctggccttccagcaaatccctccccaggaccagccccacaggccaccagtgtgaagttgcccacccccatgcagagcctgggtgccatcaccacgggcaccagcaccattgtccgtaccattcctgtggccaccactctctcctccttgggtgccactcctggtgggaagcccacagccatccaccagctgctgaccaatgggggcctcgctaagttggcaagcagcctccctggcctggctcagatctctaaccaagcatcaggcttgaaggtccccaccaccattactctgacacttcgtggccagccgagcaggatcactacactgagccctatgggctcaggagcagccccatccgaggagtcctcttcccaggtgctgccctccagctcacagcaacatggatgaacttggaggacatgttaagtgaagtaagtctggacagaaaaatactgcgtgttctcacccacagtgacctcgggcaactcaatctcccttagcctcatcctgtggaacccgggatgagaacagaactttctcctaagggggctgtgagaagaaataactcctgggacctgcctagcaccaagcctggagcaaagtcagtacggaataaatattattgtcctgccta

SEQ ID NO: 308905 - DNA, 2497 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggacagaagctgtgctgacccacaaacaagctcaagttcccatttcatcagaaccaccagaggaaggagagaaagaggatcttagggttcagctgaagcgacaccatccctcgagtccccttcctggcagtaagacctccaaacgaccgaagatcaaggtgtcccttatctcccaaggggacacagctggagggccttgtgctccttcccaaggaagtgctccagaagctgcaggtgggaagcccatcaccatgacactggggcaggcttcagcaggggccaaggagctcacaggacttctcaccacagccaagtccagttcttctgaaggtggagtctcagccagcccagtcccttcagtggtctccagcagcactgcacccagtgccttgcacacactgcagagccgcctggtggccacatctcctggcagctccctcccaggtatcttgtggcccagcattctccccttccaacacagaatttttggtctgctgcttctgggtggtcctgggaaagcatccctggagctaaatccataggatgggcctctgggtcttagagtgatcatagaggcttgacgtgaagctggaattagcttgggcagagggattccttggccttgaataaatgcagtgagta

SEQ ID NO: 308906 - DNA, 2079 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcagaataagcaaagcaaagaagaaatcagaagggttgactcagagcatggtggacagatgtattcaggatgagattgtggactttctgactggagtgctcactcgtgctgagggtcacatgggctctgaacctcgggatcaggatgctgagaagaagaagaagccccgcgatgtggcccgcagagacttggcctttgaagtccctgagcggggcagtcgacctgcctccccagctgccaagctgcccgcctcaccctcaggctcagaggatctctccagtgtgtccagcagccccacctccagtcccaagaccaaagtgaccacagtgacctctgcccagaagtccagtcagattggaagttctcagctgctgaagagacatgtgcagcggaaacccaaggcagacaactgcagtgacatactccattactgacacatgacaggccaccaaagctcctgtgttccagccaatcaagataataggtttgtgtgggaaatggctgtgaatctccagcactttgcttctcactgccccaatcatatgctcgagacactgtagaactcctaccccactgccattgttcagcagatgggtggctacatgatgactacg

SEQ ID NO: 308907 - DNA, 1853 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgctctgtacaaaatgagctaagtagctaaggtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacaggactggctggacaatggcccagaacaagctattcaacaagatcctcaaagccctgcagtctgaccggcttgcccgcttggccaacgaaggggcttgtaatgagccagtgctgcgccgtgttgctgtggacaagtgtgcaaggagagtgcggcaggctctggcaagtgtgagctgggataccaagctgatccagtggctgcacaccacccttgtggagaccttgagtctgcccatgctggcagcctacctggatgctttgcagacgctgaaggggaagatcccaaccttgattgaccggatgcttgtgtcatccaacacaaagactggggctgcaggagctgaggccttgtctctcctactgaagaggccctgggaccctgctgtgggtgtgctttctcataacaaaccaagcaaactccctggctctccgctgattctcatcgcctcctctggtccctccagctctgtgtttcccacttcacgccgccaccgcttctggcaatctcagctgtcctgcttgggcaaggtcatccctgtagccacccatctgctgaacaatggcagtggggtaggagttctacagtgtctcgagcatatgattggggcagtgagaagcaaagtgctggagattcacagccatttcccacacaaacccattatcttgattggctggaacacaggagctttggtggcctgtcatgtgtcagtaatggagtatgtcactgcagttgtctgccttgggtttcctctgcttactgtggatggccccagaggggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcaggtgggtggattctcccagagctgcaagagagctgtgttacagtgttagagataagcctggaagctggcaatgtaactacagaccagtctggttcagttaaaagacagcattagccgggcgcggtggctcacgcctgtaatcccaggactttgggaggctgaggcaggcggatcacgaggtcaggagattgagaccatcctggctaacacggtgaaaccccgtctctactaaaaatacaaaaaattagccaggcctggtgtcgggcgcctgtagtcccagctactcgggaggctgaggcaggagaatggtgtgaacccagaaggcggagcttgcagtgagccgagatcccgccactgcactccagcctgggtgacagagcaagac

SEQ ID NO: 308908 - DNA, 1352 bp, Homo sapiens
cgtggaggcgttaacgcgcacgcgcttagggatccggccgtggccgagcgcgcggccgtaagaccgcgggtgactagcatgcagatacccatgctctgactttctgcccctccactgacatggcccaccggggtggggagagggacttccagacttcagctcgacgcatgggcacctcgctgctcttccagctttcagtgcatgaacgggagctggacctggtttttctggatcatagctatgccaagccttggagtgcccacccagatgccagtagtgcccgccccacccgcatgctctttgtcactccccggcggcagcacgaaagtaccatgtgaatcagacgtcccaatagatgtggagacggtcacatcaacgcctatgccactctatgacaatcagaaggcacgcagcgtgatgaatgagtgtgaacggcatgtcatctttgccaggactgatgcagatgcccctcctccaccagaggactgggaggagcatgtcaacagggtctcactctgtcacccagactgcagtgcagtggcacgatctcggctcactacaagccttgacctccaggactcagtctccttgtggaccaccacccttctgttatgacattgccacattgccacagattgatgcttacacaccatctcttttggtaggtaacttttgtacatagccgattttattatttatgataacttattagtttcagtttcagataccaccattttatgaccctgtccctgaatctgtagcctgtttggagcttgcagttccttctgctctgattataatcatcgtgttgccattctttccctgacttgattgttaaattgctgcttcctttcttcttatataaagtcatgtaaaattagtttgccacatcaagagctccatgaacggtgtaggtcggctccctagaactctggagttctttcccggagagtttactgattgctctttgtctgtggaggcagaaacttaatttccttgttaagagcttttttcctctctcttgaatgatttcagtagaaactgtcttcagatagctttgtgtatataggctaggcgcagtagctctcgcctgtaatcccagcactttgggatgctgaggcgggaagataatttgaggtgaggagtttgagaccagcctgaccaacatagtgaaaccccgtctctactaaaaatagtaaaaattagctggtgtggtggcaaacgcctgtaatctcagctactcgggaggctgaggcaggagaatctcttgaacctggaaggcagaggttgcagtgagccgagatctgtgccactgcactccagcccgggcaacagagcaagactccgtctca

SEQ ID NO: 308909 - DNA, 755 bp, Homo sapiens
agtgtctgatgagattttggaggccttctctcattggcagcaggcttacacaccatctcttttggtaggtaacttttgtacatagccgattttattatttatgataacttattagtttcagtttcagataccaccattttatgaccctgtccctgaatctgtagcctgtttggagcttgcagttccttctgctctgattataatcatcgtgttgccattctttccctgacttgattgttaaattgctgcttcctttcttcttatataaagtcatgtaaaattagtttgccacatcaagagctccatgaacggtgtaggtcggctccctagaactctggagttctttcccggagagtttactgattgctctttgtctgtggaggcagaaacttaatttccttgttaagagcttttttcctctctcttgaatgatttcagtagaaactgtcttcagatagctttgtgtatataggctaggcgcagtagctctcgcctgtaatcccagcactttgggatgctgaggcgggaagataatttgaggtgaggagtttgagaccagcctgaccaacatagtgaaaccccgtctctactaaaaatagtaaaaattagctggtgtggtggcaaacgcctgtaatctcagctactcgggaggctgaggcaggagaatctcttgaacctggaaggcagaggttgcagtgagccgagatctgtgccactgcactccagcccgggcaacagagcaagactccgtctca

SEQ ID NO: 308910 - DNA, 378 bp, Homo sapiens
tttgcagacgctgaaggggaaggtaaggctgtgattggggtctgccctgtcctagggatagccatcctcccctgtgggttcaggatgtggggttaggcaaagtaattatctggtcggtctggagtgcatggccaaaactaatgggtttggtactaaaattgggagacagggtatcatttcacatttgtgtctggtgtaaacgttttcagccctgctggctccaggatgaggtatggggcctgaaaaccagagtatacatttagccttcctagccttgcagcttgtggtttgagtcatggctgaattgaattatcatgaaggagacgaagggtttaccagggaagagtttgttgagaaaggtgacagaagcagaccctt

SEQ ID NO: 308911 - DNA, 349 bp, Homo sapiens
gcgttggcttcgaggggagtggcgggccgtggggatcgcggccgtggttgggacggccgggggtctcggcgagggcttcagggctcccggggcatgcgggggcccgggctagggccggctgccggtgctggtcgggcggggcgggtcgggccgggggcgggctggcaggggccgcgtctgggcctccgtgacgcggacgccgagccctgccccagggagcgggaggcgggaggcgggggccaggcggctcctcctcgtcgcgaactctggatgaccttggccaaatcgcttcagttccccgagctggcgacttcgtctgtaaaatgcgagtcatagccctgtctcctag

SEQ ID NO: 308912 - DNA, 182 bp, Homo sapiens
tccatggttatgattaagaggtttttgtggacaattcatacttatcaaagtcattagagacttaataatactataaataccagtttgtttcttttttcttttttttgagacagggtctcactctgtcacccagactgcagtgcagtggcacgatctcggctcactacaagccttgacctcca

SEQ ID NO: 308913 - DNA, 412 bp, Homo sapiens
agtacattgtggcatacccagcattctggggttgttctgcacctatctttggcctcctgtcttactgtcttctttctcttcccatgaagattcacagccatttcccacacaaacccattatcttgattggctggaacacaggagctttggtggcctgtcatgtaagtaatttctatcttatttggaggttgtcctgggatggaataccactaatcatagctaccattgagtcctttactgtgtgtcaggctctgcgctagatactttacctatataattacattttaaactgtagaagacaaattttattaaaacaatttttaatttattttggaaaactttaagcagaaacaaaagcaggtgtagtataataaacccccggatcctcacccagctttaccagtgatcaact

SEQ ID NO: 308914 - DNA, 424 bp, Homo sapiens
tggctgatcctccttagtggagtttctgggtcagtgctttgtgaatatgaagaagccgattctaaaacctatacctgttttaggatgtagatgatcccctcttggatatgaagactccagtcctctttgtcattggtcagaattcccttcaatgtcaccctgaagccatggaggacttccgggagaagattcgagctgagaacagcttggtggtggttgggggagctgatgacaatctcaggtgggtggattctcccagagctgcaagagagctgtgttacagtgttagagataagcctggaagctggcaatgtaactacagaccagtctggttcagttaaaagacagcattagccgggcgcggtggctcacgcctgtaatcccaggactttgggaggctgaggcaggcggatcacgaggtcag

SEQ ID NO: 308915 - DNA, 204 bp, Homo sapiens
tgtcctgtgacctttggataacagagctccttcctttgtctccaggtccagttcttctgaaggtggagtctcagccagcccagtcccttcagtggtctccagcagcactgcacccagtgccttgcacacactgcagagccgcctggtggccacatctcctggcagctccctcccaggtatcttgtggcccagcattctcccctt

SEQ ID NO: 308916 - DNA, 389 bp, Homo sapiens
cagtaagacctccaaacgaccgaagatcaaggtgtcccttatctcccaaggggacacagctggagggccttgtgctccttcccaaggaagtgctccagaaggtgagtttctcttggtacgttaaatgagaactgagctctctcaggtacacagcattgccctttggtggccattcaccagcatgtcagcctttgctttattttgagagatgcccggagcaaagaagacatgagtctgtacatgtgggtaaagttggcatgagtccatctgaatgaggaccaggcaggcagaatatgagaggaagctgtgccatcgttcaaagcatcctatattttgttctttttttgttggcttcaattaaaggtacagaatatttcaggaagtttaga

SEQ ID NO: 308917 - DNA, 352 bp, Homo sapiens
agagaaacactgacagattcttgtctttggcttatctttctccagtctccttgtggaccaccacccttctgttatgacattgccacattgccacagattgatgtaatccattaaagctcaatttatcagattatttgttttcttagtgtctgatgagattttggaggccttctctcattggcagcaggcttacacaccatctcttttggtaggtaacttttgtacatagccgattttattatttatgataacttattagtttcagtttcagataccaccattttatgaccctgtccctgaatctgtagcctgtttggagcttgcagttccttctgctctgattataatcatc

SEQ ID NO: 308918 - DNA, 949 bp, Homo sapiens
ctcaatgcaagctctccctcctgggttcacgccattttcctgtctcagcctcccgagtagctgggactacaggcactcgccaccacgcccgcctaatttttttgtatttttagtagagacaaggtttcaccatgttagccaggatggtctcgatctcctgaccttgtgatccgcccacctcggcctcccaaagtgctgagattacaggcgtgagccaccgcacctggccagaacttaatttttttttttaaattttcactctaccaagtctcaggcgctgattaggactttataaataatgaagtcaaactaatattttttcagttaaatagtagattaccttggtgcaaagcaggtaacatttctatcccatggctgccatttaaatctctagaaaagtgatctgggaaagcatagtaattgatacctttgctagctgttttaagttttcagtgttataaacatgaatggatattgacttatttttaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308919 - DNA, 1835 bp, Homo sapiens
atttttagataatcattaaagaccacagaaaatgtaacagatcctactcttcaaaataattgctattcagtattaaaacgagcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308920 - DNA, 1744 bp, Homo sapiens
atttttagataatcattaaagaccacagaaaatgtaacagatcctactcttcaaaataattgctattcagtattaaaacgagcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308921 - DNA, 549 bp, Homo sapiens
  misc_feature (39)..(39): n is a, c, g, or t
gcggccgcctactactactactactactactaattcgcngcgctcgagattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308922 - DNA, 801 bp, Homo sapiens
ctcaatgcaagctctccctcctgggttcacgccattttcctgtctcagcctcccgagtagctgggactacaggcactcgccaccacgcccgcctaatttttttgtatttttagtagagacaaggtttcaccatgttagccaggatggtctcgatctcctgaccttgtgatccgcccacctcggcctcccaaagtgctgagattacaggcgtgagccaccgcacctggccagaacttaatttttttttttaaattttcactctaccaagtctcaggcgctgattaggactttataaataatgaagtcaaactaatattttttcagttaaatagtagattaccttggtgcaaagcaggtaacatttctatcccatggctgccatttaaatctctagaaaagtgatctgggaaagcatagtaattgatacctttgctagctgttttaagttttcagtgttataaacatgaatggatattgacttatttttaggaaacgtaaatattttcaccacgatcgattagactgggatgaacacagttctgccggcagatatgtttcaagacgctgtaaacctctgaaggtaagcctttgagacattgctcaaatagtcaaaactgagtttcttctgtttgtcttttgagaccgagccttgcttcgttgtccaggctggagtagagtggcacgatgttggcccagctcactgcaacctctgcatcctaggctcaagcaggtctcagcctcccaagtagctgggattacagatggatgccaccacgctttttttttttttttttttttttt

SEQ ID NO: 308923 - DNA, 3221 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308924 - DNA, 3953 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattgtaagttcttggtatatcttcgttaatttgctggttttatccattccacatatcaaaatgtgcatcctaagtgtgtacaatttttatttgattaaaaataaagggggaggaagaataggtatgaagagatttgattacaggctgttgatccagcagtgtacatttcattcagcaagtaggatatccaccatataacaacgtactttgttgcagactatgatttagacttttctgatgcgcaaaaatagtaacttcgaatgctgggtaaaaattaaggcgtgatatatctcataaaagaaagcttcataagaggtagtaagttttagttactggtgattttctagcagactggaatgttgaccattctttgggaaaggaatcagaggttttttgttgggtttttttgttttttgaaatggagtctcgctttgttgttcaggctgaagtgcagtggcgcagtcttcactcactgcaaactctgcctccccagttcaagtgattctcctgcctcagcctcccgagtagctaggactacaggcacacgccaccacacccggccaatttttgtaattttggtagagacagggtttcaccatattggtcaggctggtctcgaactcctgacctcaggtgattacaggcgtgagccactgcacccggcctgttgtggggttttgtgatttggtttggtttggtgttttctgattacagcaactttctctttattctcagttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308925 - DNA, 3183 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308926 - DNA, 3237 bp, Homo sapiens
atgttgtgaaccgcctcggcggagctgtaagatggcggctgggcggaggccggcttcggccctgtggccggaaaggcgaggctccccgttgaggggggatttgctggggttccagaatgtgcgtgagccaagcagctgtggggaaacgttgtctggaatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308927 - DNA, 3322 bp, Homo sapiens
tcgttgtttttccctgtgttcgctggtgcttattttcatgcgtgcgccaccgctccatgtccctttgaaatgaggacaggagctgccagtcacagcggctgcactaacactctcaggtctgtgcaaactccatttgtcccagcaggcactttgctgagactctcaactgtgattgtagtatataagtggagcggtggggtgtggggtacaatttaactaggaaaaacttgccttttatgtagatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308928 - DNA, 2199 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308929 - DNA, 2843 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308930 - DNA, 1821 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308931 - DNA, 1730 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308932 - DNA, 1627 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccgatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308933 - DNA, 4041 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttgtaagtatcagattagaacttgggaagtggtatcaggtatatttaaattaggagcaactatacttagctatttttcatgtgtttgtagccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattgtaagttcttggtatatcttcgttaatttgctggttttatccattccacatatcaaaatgtgcatcctaagtgtgtacaatttttatttgattaaaaataaagggggaggaagaataggtatgaagagatttgattacaggctgttgatccagcagtgtacatttcattcagcaagtaggatatccaccatataacaacgtactttgttgcagactatgatttagacttttctgatgcgcaaaaatagtaacttcgaatgctgggtaaaaattaaggcgtgatatatctcataaaagaaagcttcataagaggtagtaagttttagttactggtgattttctagcagactggaatgttgaccattctttgggaaaggaatcagaggttttttgttgggtttttttgttttttgaaatggagtctcgctttgttgttcaggctgaagtgcagtggcgcagtcttcactcactgcaaactctgcctccccagttcaagtgattctcctgcctcagcctcccgagtagctaggactacaggcacacgccaccacacccggccaatttttgtaattttggtagagacagggtttcaccatattggtcaggctggtctcgaactcctgacctcaggtgattacaggcgtgagccactgcacccggcctgttgtggggttttgtgatttggtttggtttggtgttttctgattacagcaactttctctttattctcagttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308934 - DNA, 3327 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaaaaaaacagaacaacacacacaccacaaacagcacaaacacaaacaaaaaaagaacaaaacacccacacacaaccacccaaaaacggacaaacaccacaaacacacg

SEQ ID NO: 308935 - DNA, 1439 bp, Homo sapiens
tttccccactgtatcctaactcttttggcaacctggactaaaagaacatttgagataatgtttgacagtgacaggtaccatataggaagaagttgtttagctgaaataccaaaaaataactcatgtgagtggtggtttgatgaaagaaatttgtgtcattcagcatgtaatagaatcagaactgaacactaaaccataaattaaaaaaatacagtgggtcagagtagtagtacagtttgaagacagtaatacctggaattgagcatcatgtctgtcattcttaaatttgcatgcatctttctaacaggggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308936 - DNA, 1527 bp, Homo sapiens
tttccccactgtatcctaactcttttggcaacctggactaaaagaacatttgagataatgtttgacagtgacaggtaccatataggaagaagttgtttagctgaaataccaaaaaataactcatgtgagtggtggtttgatgaaagaaatttgtgtcattcagcatgtaatagaatcagaactgaacactaaaccataaattaaaaaaatacagtgggtcagagtagtagtacagtttgaagacagtaatacctggaattgagcatcatgtctgtcattcttaaatttgcatgcatctttctaacaggggaggtagacatgtagcagtaaaaatagttaaaaatgtggatagatactgtgaagctgctcgctcagaaatacaagttctggaacatctgaatacaacagaccccaacagtactttgtaagtatcagattagaacttgggaagtggtatcaggtatatttaaattaggagcaactatacttagctatttttcatgtgtttgtagccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308937 - DNA, 3529 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccagtaagtgacaatgatctatttcaaccttgctttgcacaagaaaggtgcctgtttatatgaataaatacttttgcttcccccattatagactattaattgtagataagcataaataaactaattcatatttctttcataattgttttatttaaaacatctttcagtatataagcaattatccgtgtccatgtagggaatcattggcgagtttgttctgcaagccttaatgttagtttttttgctgtcagctttaactgtgtctgttttggtggtcatcttccccaagtctgtttttattttatttctagacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308938 - DNA, 3294 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatatgtatctgaacagtttgttctaagtaccatttttcttcctacttctattaaagaatggacatagat

SEQ ID NO: 308939 - DNA, 1314 bp, Homo sapiens
agcgcactagcctcatgcactaccctcatacatactgaaagccacttactttttaaatgtctggacactttggacttacaccacagagatgtaaaacaccacaaattgcttctcccaaatgtaatggtttttcttttttgttttttgaaatggagtctcgctttgttgttcaggctgaagtgcagtggcgcagtcttcactcactgcaaactctgcctccccagttcaagtgattctcctgcctcagcctcccgagtagctaggactacaggcacacgccaccacacccggccaatttttgtaattttggtagagacagggtttcaccatattggtcaggctggtctcgaactcctgacctcaggtgattacaggcgtgagccactgcacccggcctgttgtggggttttgtgatttggtttggtttggtgttttctgattacagcaactttctctttattctcagttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308940 - DNA, 3168 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaatgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308941 - DNA, 3134 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagatacgtatctctaacattagctcatactatgaaatgtatttgtaaaatcaatagtttggcatataatagttatctaataggataatgtaaccagcacgatataataatgaagaaatgaagcaactttacacagacgaagtaacttccaaggaatatacttaagaaacgttcagtgctaatatgaagcaaccgtaagaagatatggagagacctgtc

SEQ ID NO: 308942 - DNA, 675 bp, Homo sapiens
cgatctagaggatctcgtattctaacattatagagcacctgaagtattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308943 - DNA, 3073 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggtaagcctttgagacattgctcaaatagtcaaaactgagtttcttctgtttgtcttttgagaccgagccttgcttcgttgtccaggctggagtagagtggcacgatgttggcccagctcactgcaacctctgcatcctaggctcaagcaggtctcagcctcccaagtagctgggattacagatggatgccaccacgctttttttttttttttttttttttt

SEQ ID NO: 308944 - DNA, 486 bp, Homo sapiens
  misc_feature (13)..(13): n is a, c, g, or t
agccggacctccngttacacagctaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308945 - DNA, 2493 bp, Homo sapiens
atcgagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatggggtatgaacgtttttaaaacattttggaaattttatatcccatgtggaacagggaaacttgaatttttgtgtttgattatttgagaaagttttaagatgaaatcatctcagttttaacctgcaggattttttctgtgtttgtgcattggataggaaattccggaaataaagtacacatttagttctataatttaattattggttggctcctaattgacattccagtgaaatgatgggagttaattgatttaatttagattagttgaaaattattacaaaatattctaaaagggttttttgtggtacttcaagaaacctgattagttttgatctattgaaatcacaaaagtagaacagggcattttatttttgtataatttaggattaggtatgcttctttgttctaacaagtcatgttttctaacccttctttcactaagcaaaccagaacagatttgaactgttatgggttatatattagtatggagatcagctcagatgacattaaaaatgccgtagtgttattcttgtatgccaaatctttttttccccaaaattagcactttaattttatttactgttataatatttgttttcttagattaggtaggaaatcttaatttggccaccgcctactttgacaagtaaatattacatcatacgattttgcaacattaaattagaacactagaaactaaaaaattatgtttcagtgaatgctacaactaagcattttttttttttaagaaaaacaattgtattatgttttgttgccttgccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatgcctgaatatctccccgctgaatgaatttcgtattctgccctgaattcactcgggtatattgattggctggatgatcttggtgccgcccacttgacgtttccagaagagtcaccgaaggaaaagaaccaggagtgtagaggatgatgaggagggtcacctgatctgtcagagtggagacgtactaagtgcaagatgtatagaatatttttcaacacttattaacttttcagataacataatctatatatagattaagctttcagggatttggaaatctttttttctttctcttttttgtttttgttttatttttccatttcttttggtgggggggattgtatttttgctttctttagaaatgtaatgtttgttatatagaacttccagaacagtaatcaaattaatgaaattagacctaataattatgttttttgatggtgttgaccaataaaatatctagtgataaggaaatttgtagcatcaactagaataatctacattgatagcatttattgtgataagtacattgtttccacttcttgatatgactgagatttatttctctcttttagatgaaattgttgatactttaggtgaaggagcttttggaaaagttgtggagtgcatcgatcataaagcgtaagtttcccatgttgggattacttttagggaagttggcaatacaggtaattgatttagctttagaaagtggtctgaccatgagttagatacatatctttatacccttttttacttggatgtaagacacttccagttaagaggtacttgccccttcatattttttaaacagctactaatagtatgtataatttctaattttaggctgagaacacactttatattgttttgaaagtattgttttgttgttcaactggacactgttgttaggccatatttttttcccccaccatattagtggttctcagccttggttttatgttaagatcctcctcgagaggtttgcctaccccagaccttttcagggtagttacctaggaatctatatttttaggaagtgctgt

SEQ ID NO: 308946 - DNA, 600 bp, Homo sapiens
tcaagtaaagacaagttttactatgttggcctggctggtcttgaactcctggcctcaagtgatccacctgccttggcctcccagagtgctgggattataggcgtgagcgaccatgcctggcctcttttctgtttttatggtggttatatatatatggtttactatactgttacatagtgtagtcaatggtagtggaaaaggctgttgaatgaatttctttttttcttccaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaa

SEQ ID NO: 308947 - DNA, 453 bp, Homo sapiens
gcctccccagttcaagtgattctcctgcctcagcctcccgagtagctaggactacaggcacacgccaccacacccggccaatttttgtaattttggtagagacagggtttcaccatattggtcaggctggtctcgaactcctgacctcaggtgattacaggcgtgagccactgcacccggcctgttgtggggttttgtgatttggtttggtttggtgttttctgattacagcaactttctctttattctcagttttgcacagtaataagttgactcacacagacttaaagcctgaaaacatcttatttgtgcagtctgactacacagaggcgtataatcccaaaatagtaagtcttccaaaatattcataaagtatcttatgccttaatagcttatgccttcttaaccatcatttatgattttcagaaacgtgatgaacgcaccttaataaat

SEQ ID NO: 308948 - DNA, 2396 bp, Homo sapiens
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaagccctatagtcgctcttcctccatgtcttccattgatctagtcagtgcctctgatgatgttcacagattcagctcccaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacaggtactagaagatatgttttatctttttttaactttatttgactaatatgactgtcaatactaaaatttagttgttgaaagtatttactatgtttttt

SEQ ID NO: 308949 - DNA, 2318 bp, Homo sapiens
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacaggtactagaagatatgttttatctttttttaactttatttgactaatatgactgtcaatactaaaatttagttgttgaaagtatttactatgtttttt

SEQ ID NO: 308950 - DNA, 1655 bp, Homo sapiens
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaagtgaagagatggtgtgagagaggagtaaaggatgataccagggatttcttgtagctggtgggcgttgccatgtataaggaacagggaagacttgggacgaacgcgtgtggaagtaagatccaggagttggg

SEQ ID NO: 308951 - DNA, 364 bp, Homo sapiens
ggaccttccttggtgtgttgaaaatcaaggattttatcccagattttcaacccaaggatgagctgcaatataactatcactgttttgttggctgcctgccacagaatgaccactgaggaaataaagcgagctttggattcactgcagcttggtttactgtggttcttttctgtattaccgttgttaggattgggaggtttaagtggtaactgggtccagcagcagggaatctgcgtgcagcagctaaatcaaggtttagtcaatgtccaaaacactttagcaaattggatatcagtaattccccagcaccctaaaacagttcccagagcaagtatttattgagctcctactacatgccatgaag

SEQ ID NO: 308952 - DNA, 5318 bp, Homo sapiens
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagtgactgaagcaaggctgtgtgacattccatgttggagaaaaaaagaaaaaaaaaagctgaatgctctaagctggaacgtaggatctatagccttgtctgtggcccaagaccttggccttgtgtacaaaaatgacaaaatattgcaatagcaaagctgaacatctaacactagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattcattgctgctgatttctataatgattcatgttgtcatgtgtctcttaataactgagggctgtcagtaacctgtgattttgccttttctatagtcttactcccatgaagaaccttggttctgatggagaaagtgaaaagctttatttcttcccctagatatctttatatttctattatattttttagttgtgtactgtgtactagagatttttttcagtttgttatgaacacaatttggtaagccctaaattggttctgcctgtctccaaacagaaacatctgtacaaatcttgttggtatagactactttctggaaaatggtcaagataagttcatgttttcttgaaatttctaagatagtatatggtatcacttgtttaaagcaaatcagactgagtttgacatttaattcaatatttctggtattcagtaacgggtatatatgtttgttcttccagtttgggtcagtttaaaagatatgttgcaaagtatacatagaaaatgtgagcaatgcctctctttgccttttgatcagaaacttcagcagagcggtaaggattccacatgatttaaactgaaatgcttttctttgttgctgtaagaacttaaaatgtaaaatacctttttcagtttaagtcctgtaaacaacattgaagcatggagatgaggcaaggaatagtactcactgaagttgaaatgactgcccacttcaaaatcttcattgtgtttacacaccagtgtatttatacaaatcagaggcattttgtagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagaaaaatacatataaaacatatgcttacattacatgcacgcggatttcatgctccataatcttttctattttttaatttacctttctgtaaatgatgtgcatggaatatgccttatagaaaaatgctgttcataatttgactacgtggaaaagtgcctatatggtggtaatgctagtaaggcaaataagacaaattatcatgttggtttactacatcaccagttaacattttatattgtgatgtttaaaaaagaaaaatttatacctcaaatgtgtattttattttacaatcagctgtggggtatggggttgggatgggagaatgggggggttggggagggcaggtttattcaccatagccgctgataagaatcttcaaaaaaattctatatgcgcactataaatgtttctctgtttgccatttctggtaactatcatgaacacagacagttaactctttcataactgaattggatagctttattttacagaagtatggcaagtttacaaagcaatatctaaatctaattatcattagttgcatttggactaaatgtgatgatatacttttgcaattgattctgtaaataaaaggattacactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaactaccctttactctcttttctactcagttactcttttgtgctatgttagaaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaaaaaaaaactg

SEQ ID NO: 308953 - DNA, 5260 bp, Homo sapiens
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagtgactgaagcaaggctgtgtgacattccatgttggagaaaaaaagaaaaaaaaaagctgaatgctctaagctggaacgtaggatctatagccttgtctgtggcccaagaccttggccttgtgtacaaaaatgacaaaatattgcaatagcaaagctgaacatctaacactagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattcattgctgctgatttctataatgattcatgttgtcatgtgtctcttaataactgagggctgtcagtaacctgtgattttgccttttctatagtcttactcccatgaagaaccttggttctgatggagaaagtgaaaagctttatttcttcccctagatatctttatatttctattatattttttagttgtgtactgtgtactagagatttttttcagtttgttatgaacacaatttggtaagccctaaattggttctgcctgtctccaaacagaaacatctgtacaaatcttgttggtatagactactttctggaaaatggtcaagataagttcatgttttcttgaaatttctaagatagtatatggtatcacttgtttaaagcaaatcagactgagtttgacatttaattcaatatttctggtattcagtaacgggtatatatgtttgttcttccagtttgggtcagtttaaaagatatgttgcaaagtatacatagaaaatgtgagcaatgcctctctttgccttttgatcagaaacttcagcagagcggtaaggattccacatgatttaaactgaaatgcttttctttgttgctgtaagaacttaaaatgtaaaatacctttttcagtttaagtcctgtaaacaacattgaagcatggagatgaggcaaggaatagtactcactgaagttgaaatgactgcccacttcaaaatcttcattgtgtttacacaccagtgtatttatacaaatcagaggcattttgtagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagaaaaatacatataaaacatatgcttacattacatgcacgcggatttcatgctccataatcttttctattttttaatttacctttctgtaaatgatgtgcatggaatatgccttatagaaaaatgctgttcataatttgactacgtggaaaagtgcctatatggtggtaatgctagtaaggcaaataagacaaattatcatgttggtttactacatcaccagttaacattttatattgtgatgtttaaaaaagaaaaatttatacctcaaatgtgtattttattttacaatcagctgtggggtatggggttgggatgggagaatgggggggttggggagggcaggtttattcaccatagccgctgataagaatcttcaaaaaaattctatatgcgcactataaatgtttctctgtttgccatttctggtaactatcatgaacacagacagttaactctttcataactgaattggatagctttattttacagaagtatggcaagtttacaaagcaatatctaaatctaattatcattagttgcatttggactaaatgtgatgatatacttttgcaattgattctgtaaataaaaggattacactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaaaaaaaaactg

SEQ ID NO: 308954 - DNA, 5396 bp, Homo sapiens
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaagccctatagtcgctcttcctccatgtcttccattgatctagtcagtgcctctgatgatgttcacagattcagctcccaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagtgactgaagcaaggctgtgtgacattccatgttggagaaaaaaagaaaaaaaaaagctgaatgctctaagctggaacgtaggatctatagccttgtctgtggcccaagaccttggccttgtgtacaaaaatgacaaaatattgcaatagcaaagctgaacatctaacactagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattcattgctgctgatttctataatgattcatgttgtcatgtgtctcttaataactgagggctgtcagtaacctgtgattttgccttttctatagtcttactcccatgaagaaccttggttctgatggagaaagtgaaaagctttatttcttcccctagatatctttatatttctattatattttttagttgtgtactgtgtactagagatttttttcagtttgttatgaacacaatttggtaagccctaaattggttctgcctgtctccaaacagaaacatctgtacaaatcttgttggtatagactactttctggaaaatggtcaagataagttcatgttttcttgaaatttctaagatagtatatggtatcacttgtttaaagcaaatcagactgagtttgacatttaattcaatatttctggtattcagtaacgggtatatatgtttgttcttccagtttgggtcagtttaaaagatatgttgcaaagtatacatagaaaatgtgagcaatgcctctctttgccttttgatcagaaacttcagcagagcggtaaggattccacatgatttaaactgaaatgcttttctttgttgctgtaagaacttaaaatgtaaaatacctttttcagtttaagtcctgtaaacaacattgaagcatggagatgaggcaaggaatagtactcactgaagttgaaatgactgcccacttcaaaatcttcattgtgtttacacaccagtgtatttatacaaatcagaggcattttgtagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagaaaaatacatataaaacatatgcttacattacatgcacgcggatttcatgctccataatcttttctattttttaatttacctttctgtaaatgatgtgcatggaatatgccttatagaaaaatgctgttcataatttgactacgtggaaaagtgcctatatggtggtaatgctagtaaggcaaataagacaaattatcatgttggtttactacatcaccagttaacattttatattgtgatgtttaaaaaagaaaaatttatacctcaaatgtgtattttattttacaatcagctgtggggtatggggttgggatgggagaatgggggggttggggagggcaggtttattcaccatagccgctgataagaatcttcaaaaaaattctatatgcgcactataaatgtttctctgtttgccatttctggtaactatcatgaacacagacagttaactctttcataactgaattggatagctttattttacagaagtatggcaagtttacaaagcaatatctaaatctaattatcattagttgcatttggactaaatgtgatgatatacttttgcaattgattctgtaaataaaaggattacactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaactaccctttactctcttttctactcagttactcttttgtgctatgttagaaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaaaaaaaaactg

SEQ ID NO: 308955 - DNA, 5186 bp, Homo sapiens
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaagccctatagtcgctcttcctccatgtcttccattgatctagtcagtgcctctgatgatgttcacagattcagctcccaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttgtgactgaagcaaggctgtgtgacattccatgttggagaaaaaaagaaaaaaaaaagctgaatgctctaagctggaacgtaggatctatagccttgtctgtggcccaagaccttggccttgtgtacaaaaatgacaaaatattgcaatagcaaagctgaacatctaacactagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattcattgctgctgatttctataatgattcatgttgtcatgtgtctcttaataactgagggctgtcagtaacctgtgattttgccttttctatagtcttactcccatgaagaaccttggttctgatggagaaagtgaaaagctttatttcttcccctagatatctttatatttctattatattttttagttgtgtactgtgtactagagatttttttcagtttgttatgaacacaatttggtaagccctaaattggttctgcctgtctccaaacagaaacatctgtacaaatcttgttggtatagactactttctggaaaatggtcaagataagttcatgttttcttgaaatttctaagatagtatatggtatcacttgtttaaagcaaatcagactgagtttgacatttaattcaatatttctggtattcagtaacgggtatatatgtttgttcttccagtttgggtcagtttaaaagatatgttgcaaagtatacatagaaaatgtgagcaatgcctctctttgccttttgatcagaaacttcagcagagcggtaaggattccacatgatttaaactgaaatgcttttctttgttgctgtaagaacttaaaatgtaaaatacctttttcagtttaagtcctgtaaacaacattgaagcatggagatgaggcaaggaatagtactcactgaagttgaaatgactgcccacttcaaaatcttcattgtgtttacacaccagtgtatttatacaaatcagaggcattttgtagatgctttgctgacttgttcagctctgtaaaaacacagaaatcagacccattttgtaaagcggaaaatcatgttacatggaacatgtcctgtatatatcacatacatggtaatggagtcttaatgataagtgcaagataataatttaatgatgggattagtctgatcgcttaatatgcacaatcctggaagtgaattacttgcatcagatatagtgatatttattattctgtacagagagaaaaatacatataaaacatatgcttacattacatgcacgcggatttcatgctccataatcttttctattttttaatttacctttctgtaaatgatgtgcatggaatatgccttatagaaaaatgctgttcataatttgactacgtggaaaagtgcctatatggtggtaatgctagtaaggcaaataagacaaattatcatgttggtttactacatcaccagttaacattttatattgtgatgtttaaaaaagaaaaatttatacctcaaatgtgtattttattttacaatcagctgtggggtatggggttgggatgggagaatgggggggttggggagggcaggtttattcaccatagccgctgataagaatcttcaaaaaaattctatatgcgcactataaatgtttctctgtttgccatttctggtaactatcatgaacacagacagttaactctttcataactgaattggatagctttattttacagaagtatggcaagtttacaaagcaatatctaaatctaattatcattagttgcatttggactaaatgtgatgatatacttttgcaattgattctgtaaataaaaggattacactaaaatatttgtattaaaagaagaaaagataacattttacctttagataactgcacttgtacctcactagagttaatcccacccaatcagattgagaaataaattggggaatgtggaaagagtccaaaagaggtcagaatttggagaggtactggccttctggacaacatttagaccctctacaattattttcattaagctgattcctacatcctgaatattcatgttttctcatctacagatatttgtcttcccccaaactaaaagaaaaaaaactaccctttactctcttttctactcagttactcttttgtgctatgttagaaacttgaaatatattggtgatgtggggattttgtccctgactgcccactgtacaggacaagagagtacagtgtttcagttggaattcaggactcctggttttgaggtagaggatgatcactgcagtacttggtttggaattgccacaggggtagctaaaccaaaggagggttatatctgcaagggaggtgtaagaaggcaaaataaggaaaaggaggaatgggttttctatttgttcagtttcatcaactaatttatacacttaatacaacttcagtgtcaattgctattaagaaatttttagttgggctgagctggttctcttgtgaaattgtgctggttatctttaagcttatcagttatttgtccaattaaacacttttcaccagtatttagtccgagttgtacagacgatgtatttggattttgtcatggttcatctacagactcaaaacataatcattttaaagtaccttgggagtgtgtagagtaacttctataatagctttatgatcctgatgatgttttttaaacacaataaagttggatcttccatgttacaatcacagaattaaaaccagtatttaaagtggaaaagtattaaaatattatggacaaaaaaaaaactg

SEQ ID NO: 308956 - DNA, 3686 bp, Homo sapiens
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagtgactgaagcaaggctgtgtgacattccatgttggagaaaaaaagaaaaaaaaaagctgaatgctctaagctggaacgtaggatctatagccttgtctgtggcccaagaccttggccttgtgtacaaaaatgacaaaatattgcaatagcaaagctgaacatctaacactagctatctcttgctagatctccttgctcagcatataactataaatacatgtaaaattacatgtatatggctatatttttatttgcttgctcctagaagagaaaaaaaaatcaactttgaatcacaactaggaattgatgctttaatttttggatactttttcagaatttttaatttactatggtccggcctaagatcctctgttgtatcaggttttgtgcacaaaagaaaagcacaaaagttgaatgcacatggggcatgtgctttctgtgcaccaaatatctggatgaggttcttttttcaggcctacagtcaaatctgtgtccagaattttttgacttttttgctttgtataatcatagaattcattgctgctgatttctataatgattcatgttgtcatgtgtctcttaataactgagggctgtcagtaacctgtgattttgccttttctatagtcttactcccatgaagaaccttggttctgatggagaaagtgaaaagctttatttcttcccctagatatctttatatttctattatattttttagttgtgtactgtgtactagagatttttttcagtttgttatgaacacaatttggtaagccctaaattggttctgctctgtctccaaaaaaaaaaaagttttcaacttacgttattttcaacttgcagtgggcttatcagcacatagccacatcataaatggaggtgcttctgtcaaaagtacattattgttttattttcaacttacagtggggcttatcagtatgtagccccatcataagtcaaggggcttttataacgatgtgtcttacaaaatcccaccagatacagaaaggagggcagtaaagatgaaatttgatcacaattaggtgcttaaactttcttcctgtcctccagctcagaggatgaaacaggaaactgagtcataaaacactactacaaacaagcccaaggattttatcccagattttcaacccaaggatgagctgcaatataactatcactgttttgttggctgcctgccacagaatgaccactgaggaaataaagcgagctttggattcactgcagcttggtttactgtggttcttttctgtattaccgttgttaggattgggaggtttaagtggtaactgggtccagcagcagggaatctgcgtgcagcagctaaatcaaggtttagtcaatgtccaaaacactttagcaaattggatatcagtaattccccagcaccctaaaacagttcccagagcaagtatttattgagctcctactacatgccatgaag

SEQ ID NO: 308957 - DNA, 2612 bp, Homo sapiens
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagagtatcctaaatttctaaaacgttttacttcttacgtccaagaaaaaactgcaggaaagcctattttgttctagtattaacagctcagaggatgaaacaggaaactgagtcataaaacactactacaaacaagcccaaggattttatcccagattttcaacccaaggatgagctgcaatataactatcactgttttgttggctgcctgccacagaatgaccactgaggaaataaagcgagctttggattcactgcagcttggtttactgtggttcttttctgtattaccgttgttaggattgggaggtttaagtggtaactgggtccagcagcagggaatctgcgtgcagcagctaaatcaaggtttagtcaatgtccaaaacactttagcaaattggatatcagtaattccccagcaccctaaaacagttcccagagcaagtatttattgagctcctactacatgccatgaag

SEQ ID NO: 308958 - DNA, 2709 bp, Homo sapiens
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaagccctatagtcgctcttcctccatgtcttccattgatctagtcagtgcctctgatgatgttcacagattcagctcccaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggaaacattagctgataatgcaatcatcatttatcaaacacacaagagggtgtggcctgcttctcagcgagacgtattatatctttctgtcattcgaaagataccagccttgactgaaaatgaccctgaaacttggatagtttgtaatttttctgtggatcatgacagtgctcctctaaacaaccgatgtgtccgtgccaaaataaatgttgctatgatttgtcaaaccttggtaagcccaccagagggaaaccaggaaattagcagggacaacattctatgcaagattacatatgtagctaatgtgaaccctggaggatgggcaccagcctcagtgttaagggcagtggcaaagcgagaatttatgattgttcgactttatgcaaagcactacaaatacagtacactccaacttaccatggggctgcgttccgataaaccagtcatatatggaaaataccctcagaggatgaaacaggaaactgagtcataaaacactactacaaacaagcccaaggattttatcccagattttcaacccaaggatgagctgcaatataactatcactgttttgttggctgcctgccacagaatgaccactgaggaaataaagcgagctttggattcactgcagcttggtttactgtggttcttttctgtattaccgttgttaggattgggaggtttaagtggtaactgggtccagcagcagggaatctgcgtgcagcagctaaatcaaggtttagtcaatgtccaaaacactttagcaaattggatatcagtaattccccagcaccctaaaacagttcccagagcaagtatttattgagctcctactacatgccatgaag

SEQ ID NO: 308959 - DNA, 1990 bp, Homo sapiens
  misc_feature (1983)..(1983): n is a, c, g, or t
ggcacgagcaggaagatggcggcggtagcggaggtgtgagtggacgcgggactcagcggccggattttctcttcccttcttttcccttttccttccctatttgaaattggcatcgagggggctaagttcgggtggcagcgccgggcgcaacgcaggggtcacggcgacggcggcggcggctgacggctggaagggtaggcttcattcaccgctcgtcctccttcctcgctccgctcggtgtcaggcgcggcggcggcgcggcgggcggacttcgtccctcctcctgctcccccccacaccggagcgggcactcttcgcttcgccatcccccgacccttcaccccgaggactgggcgcctcctccggcgcagctgagggagcgggggccggtctcctgctcggttgtcgagcctccatgtcggataatcagagctggaactcgtcgggctcggaggaggatccagagacggagtctgggccgcctgtggagcgctgcggggtcctcagtaagtggacaaactacattcatgggtggcaggatcgttgggtagttttgaaaaataatgctctgagttactacaaatctgaagatgaaacagagtatggctgcagaggatccatctgtcttagcaaggctgtcatcacacctcacgattttgatgaatgtcgatttgatattagtgtaaatgatagtgtttggtatcttcgtgctcaggatccagatcatagacagcaatggatagatgccattgaacagcacaagactgaatctggatatggatctgaatccagcttgcgtcgacatggctcaatggtgtccctggtgtctggagcaagtggctactctgcaacatccacctcttcattcaagaaaggccacagtttacgtgagaagttggctgaaatggaaacatttagagacatcttatgtagacaagttgacacgctacagaagtactttgatgcctgtgctgatgctgtctctaaggatgaacttcaaagggataaagtggtagaagatgatgaagatgactttcctacaacgcgttctgatggtgacttcttgcatagtaccaacggcaataaagaaaagttatttccacatgtgacaccaaaaggaattaatggtatagactttaaaggggaagcgataacttttaaagcaactactgctggaatccttgcaacactttctcattgtattgaactaatggttaaacgtgaggacagctggcagaagagactggataaggaaactgagaagaaaagaagaacagaggaagcatataaaaatgcaatgacagaacttaagaaaaaatcccactttggaggaccagattatgaagaaggccctaacagtctgattaatgaagaagagttctttgatgctgttgaagctgctcttgacagacaagataaaatagaagaacagtcacagagtgaaaaggtgagattacattggcctacatccttgccctctggagatgccttttcttctgtggggacacatagatttgtccaaaagccctatagtcgctcttcctccatgtcttccattgatctagtcagtgcctctgatgatgttcacagattcagctcccaggttgaagagatggtgcagaaccacatgacttactcattacaggatgtaggcggagatgccaattggcagttggttgtagaagaaggagaaatgaaggtatacagaagagaagtagaagaaaatgggattgttctggatcctttaaaagctacccatgcagttaaaggcgtcacaggacatgaagtctgcaattatttctggaatgttgacgttcgcaatgactgggaaacaactatagaaaactttcatgtggtggactcattagctgggtgtgagcctgcgtctcggatagtttgtaattttcctgtgggtcatgacagtgctcctctaatcacacgatgtgtcgtgcaaaataaatgtgcagtgtgcttcgggggatntctagag

SEQ ID NO: 308960 - DNA, 342 bp, Homo sapiens
taacactcgtgattttacacagagcatgcatatgatctagtatactgactgctttgtaaatatgtgttcaataaatgtttattaggtcaattttcaaactcaagttaataccagagttatcagagttttctgtttctttaaataaactgcttttttctccactgtgtgttggaataggaaggccctaacagtctgattaatgaagaagagttctttgatgctgttgaagctgctcttgacagacaagataaaatagaagaacaggtatatctattattgaaaattctaagctgaaatttattttaacactataggcattccttggtgtatattatttcatgt

SEQ ID NO: 308961 - DNA, 755 bp, Homo sapiens
  misc_feature (717)..(717): n is a, c, g, or t
  misc_feature (739)..(739): n is a, c, g, or t
agttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataaagcatcattgcattgaaggattggtggctgggaagaaacaaagaaaccctgggaaagttgggaaaattgctggggaaggatgacattgttcttggccagtttgaaatttcanggccagaacggggcttacattngcttgaaaaatttttc

SEQ ID NO: 308962 - DNA, 4358 bp, Homo sapiens
ctcttctggggctgtgaacgtggggtcgaagcgcgcgtgcgcggcggctctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacaccaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtgacatcctgcacccatcctcacccctccgtagagcccctcgtgcaatgcaatgaatggaccctcctgtcactctgctgaacagaatttattttctgagtcaaatataatttattattattttcgtcaaagaagtatttaagctgtgctgtggtgtgagaatgtcattcttgatcttcagccttcgtttgcaaggagagttccagttgacgtggtgtttggttccatggcggggtaccctggggattcatctgttttcttcacttccctttgcatctgagatcctgttggaaaccacagcaacctgtattcattattaggaaataaaaatcgaaaaaaaggttcattcttttgtgttgtagttttg

SEQ ID NO: 308963 - DNA, 2782 bp, Homo sapiens
ctcttctggggctgtgaacgtggggtcgaagcgcgcgtgcgcggcggctctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctgaggctgtgtcatttgatattcccaccagcaatgcacgagggttccggtttcttcacctccttcgccaacatttgttattgtctgttttattatagtcatcttggtagatgtgaagtcgtgtctcatggtggttttgttttgcattttcctaatgaataattcagtggctcctctgtttggttcccaagataaaatacaaactccttaacctgatcttagctcctgtgtaacccagccctgtctgccactgtctctactccagccactctgtccttctgggtgtcagttcagctgcctttggctacatgtaacaaaatccatacagcagtgccattggcaagtggtagtttatttggctcaataaagaagtgtggcagtgcgtggctgccagcatgggttcagcagctggtagatgttaggggtggtgtctttgtgattctttaggcctttcccttctattttttgccttgtattttcaagatggctgttgttagaaaacttatgtttaaaggagaaagtcaaggagagggcaggcaaacatttccttgcgccctctcctccagtaagctacttgtctgtattattggccagaaccgtgccacatggttacttctagctgcaagggaggctgggacagttggatgtgctacccgaggctgagcacgttgccaccctcaacataaccagggtttgttctcaaggcaggaaggat

SEQ ID NO: 308964 - DNA, 2217 bp, Homo sapiens
ctcttctggggctgtgaacgtggggtcgaagcgcgcgtgcgcggcggctctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaaaaaaaaaaaaaaacactttgtcgggccggggctccgggggccgtagaaagaagggttttctaaaaaccaattcccggttggggggggcggtggggcgcccccatggtaggtttacgcggagacccgtggggcaaaatacgcggttgtcccctagagagagaactcggggcggcaagagacatacgcgcgttgggggagtctccctacccaaaataaaaaaaaaaccgggcgcggtcggggacacccggagcggggtttcgtggaacagaaccacccaagaagaggaggtccgaggaggggcaacatttacgcgggaacttctactacaagcaggggaggtcccagaggagaggcacgataattaaaattacc

SEQ ID NO: 308965 - DNA, 4536 bp, Homo sapiens
ctcttctggggctgtgaacgtggggtcgaagcgcgcgtgcgcggcggctctggcggcggcggtggggcggggcctgggctgtcagccggcctaggaggaggaaggagcctgcggcgtgcagtgtgaggggcgggacccggctgccggcggtgggtctagctgggggaggtcgggccatgctggtgggccagggcgcggggccgctggggcccgcggtggtcaccgccgcggtggtgctgctgctgagcggcgtggggccggcgcacggctcggaggacatcgtggtgggctgcggtggcttcgtcaagtcggacgtggagatcaactactctctcatcgagcaggtgcttaatatgcattgatgtgaatctgtacaaccacatgaaaaggagtggctctgtgtctacatctgaagaaaccgaacacgagcttgcccaaggccacgcaacacgtggaagactcagatggcatttgggcatcttactgggttaacacttcgtgtctggtaatgctcagaatataaagctgtacaccaagcatgggactttgaaataccagacagactgtgcccctaataatggttactttatgatccctttgtatgataagggggatttcattctgaagattgagcctcccctagggtggagttttgagccgacgaccgtggagctccatgtggatggagtcagtgacatctgcacaaagggtggggacatcaactttgtcttcactgggttctctgtgaatggcaaggtcctcagcaaagggcagcccctgggtcctgcgggagttcaggtgtctctgagaaacactgggaccgaagcaaagatccagtccacagttacacagcctggcggaaagtttgcattttttaaagttctgcctggagattatgaaatcctcgcaactcatccaacctgggcgttgaaagaggcaagcaccacagtgcgtgtaaccaactccaatgccaatgcggccagtcccctcatagttgctggctacaatgtgtctggctctgtccgaagtgatggggagcccatgaaaggcgtgaagtttcttctcttttcttctttagtaactaaagaggatgtcctgggctgcaatgtctcaccagtgcctgggttccagccccaagacgagagtctggtgtatttgtgctacacggtctccagagaagatggctcgttctctttctattccttgccaagtgggggctacactgtgattccgttctatcgaggggagaggattacctttgatgtggcgccttccagacttgacttcacagtggagcatgacagcttgaaaatcgagcccgtgttccacgtcatgggattctccgtcaccgggagggtcttgaacggacccgaaggagatggtgttccagaagcagtagtcaccctgaataaccaaatcaaagttaaaacaaaagctgatggctcattccgccttgagaacataaccacagggacatacaccatccatgctcagaaagagcacctctactttgaaacggtcaccatcaaaattgcaccgaacacacctcagctggctgacattattgcaacagggttcagtgtctgtggtcagatatcaatcattcgcttccccgacaccgtcaagcagatgaataaatacaaagttgtcctgtcatctcaagacaaggacaagtctttggtcaccgtggagacagatgctcatggatcattttgttttaaagcaaaaccagggacttacaaagtgcaggtgatggttcctgaggcagaaaccagagcagggctgacgttgaaaccccagacatttcctcttactgtgaccaacaggcccatgatggatgtggcctttgtacagttcttggcatcagtttctgggaaagtctcttgtttggacacctgtggtgacttgctggtgactctacagtccctgagccgccagggtgagaagcggagcctccagctctccggcaaggtcaacgccatgactttcacctttgacaacgtgctccctggaaaatacaaaataagcatcatgcatgaggattggtgctggaagaacaagagcctggaggtggaagtgctggaggatgacatgtctgcagttgagttcaggcagacgggctacatgctgagatgttccctgtctcacgccatcactctggaattttatcaggatggaaatgggcgtgagaatgtggggatttataacctctccaaaggagtcaaccgattctgcctgtccaagcctggtgtgtacaaagtgacccctcgctcctgccaccggtttgagcaagcgttctacacctatgacacgtcttcacctagtatcttgacattgacagccattcgccaccatgtccttggaactatcaccaccgacaaaatgatggatgtcactgtgactatcaagtcttccatcgacagtgaacccgccttggtcttaggccctctgaagtctgtgcaggagctgcggagggagcagcagctggctgagatcgaggcccgcaggcaggagagggagaaaaacggcaatgaggaaggcgaagaaagaatgaccaagcctcccgtgcaggagatggtagatgagttacaaggccccttctcgtatgatttctcttactgggcgcggtctggagagaaaatcactgttacaccgtcatctaaagagctgctcttttatcccccttcaatggaagccgttgtcagtggagaaagctgcccagggaagctgatcgagatccatgggaaggcaggcctgtttttagaaggccagatccaccccgagttggaaggagtcgagattgtcatcagtgaaaagggggcaagttcaccgctgatcacagtctttactgatgacaaaggtgcctacagtgttggccccctgcacagtgacctggagtacacggtgacctcacagaaggagggctatgttctgactgcggtggaaggaaccatcggagacttcaaggcctatgccctggcaggcgtaagctttgagataaaagctgaggatgaccagcccctcccgggagtcctcttatccctgagcggtggcctgtttcgttccaacctcttgacccaggacaacggcattctgacattctcaaacctgagccctggccagtattacttcaaacccatgatgaaggagttccggtttgagccatcctcacagatgatcgaggtgcaggaaggccagaacctgaagatcaccatcacggggtaccgaaccgcttacagttgctatggcacagtgtcttccttaaacggagagcccgaacaaggggttgccatggaagcggtgggccagaacgactgcagcatttacggagaagacaccgtgacagacgaagagggcaagttcagattacgtggattgctgccgggatgtgtgtaccacgttcagctcaaggcagaaggcaacgaccacattgagcgggcgctcccccaccatagggtgattgaggttgggaataatgacatcgatgatgtaaacatcatagttttccggcagattaatcaatttgatttaagtggaaatgtgatcacttcctctgaataccttcctacattatgggtcaagctttacaaaagcgaaaacctcgacaatccaatccagacagtttcccttggccagtccctgttcttccatttccccccactgctcagagacggcgagaactatgttgtgcttctggactccacactccccagatcccagtatgactacatcttgcctcaagtttctttcaccgcagtgggctaccataaacacaccaccttgatttttaatcccacgaggaagctgcctgaacaggacatcgcacaaggatcctacattgccctgccattgacgctgctggttctgctggccggttacaaccatgacaagctcattcctttgctgctgcagttgacaagccggctacagggagtccgcgcgctcggccaggcagcctctgacaatagcggcccagaagatgcaaagagacaagccaagaaacagaagacaaggcggacttgaggaggaaggggacagttgcagtctcacttgggacaggccacagccaggggtccggccactacccgcccgtgggataaaagccaaaagcatgcgtcagctaacttcagcctgtgctgctgggcccgcaccccatgtcccttgtcactgtgacatcctgcacccatcctcacccctccgtagagcccctcgtgcaatgcaatgaatggaccctcctgtcactctgctgaacagaatttattttctgagtcaaatataatttattattattttcgtcaaagaagtatttaagctgtgctgtggtgtgagaatgtcattcttgatcttcagccttcgtttgcaaggagagttccagttgacgtggtgtttggttccatggcggggtaccctggggattcatctgttttcttcacttccctttgcatctgagatcctgttggaaaccacagcaacctgtattcattattaggaaataaaaatcgaaaaaaaggttcattcttttgtgttgtagttttg

SEQ ID NO: 308966 - DNA, 390 bp, Homo sapiens
gcagaaggagtctttgtggctctggcacaggagcaccttcgagcaccttcttcttgttctttgttttctagcccgtgttccacgtcatgggattctccgtcaccgggagggtcttgaacggacccgaaggagatggtgttccagaagcagtagtcaccctgaataaccaaatcaaaggtgggctgacacagcagccccaggctgatggccagcgctctttttggatcacagagagaaatggagaggaactgatgactatatgagaacatggcagcttttggtccaagtattctggtgtacatgtaaggatacactgttgtttttggcttatcttctgtttgtgtgtttttgttttacagttaaaacaaaagctgatggctcattccgcct

SEQ ID NO: 308967 - DNA, 1532 bp, Homo sapiens
gcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacaccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaa

SEQ ID NO: 308968 - DNA, 1084 bp, Homo sapiens
attgcaacttggtcttgcatatggcaaggccaaggtgggagcagtgaacggagtcacaaaagaaatttttcagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaa

SEQ ID NO: 308969 - DNA, 2109 bp, Homo sapiens
gcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacaccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaaaaaaaaaaaaaaaaaaaaaaaaaaaaaaaaaaaaaaaaaaaaaaaaaaaaaaaaaaaaaaaaaaaaaaaaaaaaaagaagcgacgaacacgcaaaaaaataagccgcagcaaaaggaggccaacaacaacgaacgcggagccaacagcgtagaatagcacggcggcggctcctcaacagaacgacggacacatcttagagagcacaggcacacagctgcggcatctcatagcgacgcgtcgcaacctaggtgagaacgcagaccggcgcggccaggagcgcgcgctagtcccacagacaaccaccaccagacgacaaaacccacgcctggcgcggcccaagccccgagggcagcagcaccaccccaccaccacgcacggacgccaccggacccgaagcagaggagacgacaacctcacgcactaatgaaccgaagatgcagtgagtacgggggcggcagcagcaagcgacgctcagtactatcacgcggacgcgaatgggccgaaacgcgagccgttgtacggacagggctgcaagccgcgcgagaccacagcgcagggcctatacagccaccgcaa

SEQ ID NO: 308970 - DNA, 732 bp, Homo sapiens
attgcaacttggtcttgcatatggcaaggccaaggtgggagcagtgaacggagtcacaaaagaaatttttcagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttggtaagggctttcttgacagctggaaaaatggaggcacgccctgaagttggggtggagtagggggtggtgctggtgggctggaggtctttggcccttgcccatgtgggctcttggcagtgtgggcagtatgactgccgtaggctggcatcaccaggccccccaggcagctccaggaggtcccacctgtccccagtgtgcctggctggaggctaaattggcagcctaggaaggcccctgacctcacagatactgggaggggcagggagtgtgctgggggcttcctgccagccagagagactgagtggtgcacatgtggaggcgaggaagggcca

SEQ ID NO: 308971 - DNA, 989 bp, Homo sapiens
gcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacaccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgggtaagtggctcctggggcagggggtagctcctcttatgtggggctgaggagtagggttagtagggggaattcatagtgagcctttgtcacgacttatgaccagaactcagctccccagctcccagggccttctgcctgcttggaccacagactggaccagccaaccctggcagcatctggaggcagctcctggcccttcccccagccttccacagcagcaggcaggcagggttctggagggcacgtcccaggcacaaggactccgtgggcacaaggcacaaggcctctctgggagccgatgtgcaggtgcaggggcacccaaggcagggagtccggatgcttgagttctagatccattcagggcccttctgctctatacagtcctgacc

SEQ ID NO: 308972 - DNA, 324 bp, Homo sapiens
cctgggagtgggggtctgccagggctgggagaggtgactccccttgccctgaggagacccctcccagtgatgtctgcctacctctgtctccacaccagaaccaggaaatgcagagctggagcccacagagcctgggcctcttggtaagggctttcttgacagctggaaaaatggaggcacgccctgaagttggggtggagtagggggtggtgctggtgggctggaggtctttggcccttgcccatgtgggctcttggcagtgtggatgcacacgccgaggctccaaacccttggtgacacagatcacaatggacgaagttgttg

SEQ ID NO: 308973 - DNA, 291 bp, Homo sapiens
attgcaacttggtcttgcatatggcaaggccaaggtgggagcagtgaacggagtcacaaaagaaatttttcagctgtcctctctgacaccaccccggcctgcctctttgttgccatgagagctgcctacctcttcctgctattcctgcctgcttgctggctcagggccagtatgacctggacttttgacccacgttacagatacagagctcacgatacacgaaatgtgggagcagacttgacaaatcaaatactatgatatccagagagactcatcgacatatcgaggaca

SEQ ID NO: 308974 - DNA, 1041 bp, Homo sapiens
  misc_feature (20)..(20): n is a, c, g, or t
agtttaagcggggcggagtnacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaa

SEQ ID NO: 308975 - DNA, 1634 bp, Homo sapiens
gcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacaccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaaggtaacgggctaggggtaggataggacgggccggcagctggggtggggagaccccctgggaggggtagagggagcagacccccttatcctcccctggctgcagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaa

SEQ ID NO: 308976 - DNA, 1442 bp, Homo sapiens
gcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacaccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaa

SEQ ID NO: 308977 - DNA, 1001 bp, Homo sapiens
gcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacaccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgtgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaa

SEQ ID NO: 308978 - DNA, 1613 bp, Homo sapiens
gcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacaccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttatacaaaattaaaaacaagtttttacaaaataattaactaaccatagacactctcgagggggggctcggtatccacttcgccctatagtgggtccttattacaattccacg

SEQ ID NO: 308979 - DNA, 1229 bp, Homo sapiens
  misc_feature (1202)..(1202): n is a, c, g, or t
gcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacaccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatcccccnaagggcccagagtggtgggagtgagag

SEQ ID NO: 308980 - DNA, 1065 bp, Homo sapiens
  misc_feature (20)..(20): n is a, c, g, or t
agtttaagcggggcggagtnacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaagaggtgactcctcggccctccgaggaacagttccagttccagtcccagcagcaagtccaacaggaagtcatcccagccccaaccccagaaccaggaaatgcagagctggagcccacagagcctgggcctcttgactgccgtgaggaacagtacccgtgcacccgcctctactccatacacaggccttgcaaacagtgtctcaacgaggtctgcttctacagcctccgccgtgtgtacgtcattaacaaggagatctgtgttcgtacagtgtgtgcccatgaggagctcctccgagctgacctctgtcgggacaagttctccaaatgtggcgtgatggccagcagcggcctgtgccaatccgtggcggcctcctgtgccaggagctgtgggagctgctagggtggtgctggcatcctgagtcctggccctcctgggatctggggccctcgggccctgcctgacctggtgcttttttccccatccccatgttccttttattctgtaaaaagttagtggactgcagccctgggggttgcaggctgcggtgcctcaggcccctccttcagcctgtggccacctctggggcacgatgggggctccccactgcccagtctgcccctcgggttgggggagtatcccaggcctctctgtgggacctgggcccctgacgggccttctcagcccgttttgaggacagacagtcccccgaggtaggctacatccccccaccccagctggtctgcttggatttcctacagcccccgtgggcatggaccacctttattttacaaataaaccattttccaaaaaaaaaaaggcgggctaaaatacccagggcaac

SEQ ID NO: 308981 - DNA, 1282 bp, Homo sapiens
gcccagagctcagcagtgtaggagaggagggtgcgggcctgagagaggcagcaggcttggctggagaggcagaaggaaaaccaaggcaggagagtgtcctggaagctgggagaaggcagagggagatcgaggcttactttctggctgaggggcctagggtgagtcactttgggaggcttgatttcctcctctgtgaaatgggcaacacacctacccttgcccacctcacccccctcaccccgtcgacgtcgagtgaggagcagctgtgaggaggaggaagctttgcacagacgtgaggacggccccgggcgcctctaccccggggacaccccccccccaggagatggaaccccgagggcacggcgtggcggcccatgcgggcagctcgcgttaggacccagcggctccggggctggagggcgggcgccagccccgtcgggggcccggagggggactcggagcgggccaaggggcggctccggcgggcggactcggagcgggcggcggagtgacccggacagctgtcctctctgacaccaccccggcctgcctctttgttgccatgagagctgcctacctcttcctgctattcctgcctgcaggcttgctggctcagggccagtatgacctggacccgctgccgccgttccctgaccacgtccagtacacccactatagcgaccagatcgacaacccagactactatgattatcaaggtaacgggctaggggtaggataggacgggccggcagctggggtggggagaccccctgggaggggtagagggagcagacccccttatcctcccctggctgcagaggtgactcctcggccctccgaggaacagttccagttccagtcccagcagcaagtccaacaggaagtcatcccagccccaaccccagaaccaggaaatgcagagctggagcccacagagcctgggcctcttggtaagggctttcttgacagctggaaaaatggaggcacgccctgaagttggggtggagtagggggtggtgctggtgggctggaggtctttggcccttgcccatgtgggctcttggcagtgtgggcagtatgactgccgtaggctggcatcaccaggccccccaggcagctccaggaggtcccacctgtccccagtgtgcctggctggaggctaaattggcagcctaggaaggcccctgacctcacagatactgggaggggcagggagtgtgctgggggcttcctgccagccagagagactgagtggtgcacatgtggaggcgaggaagggcca

SEQ ID NO: 308982 - DNA, 1860 bp, Homo sapiens
ggcggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtaggaagaaaatgtgatttccgggtgattggtgctgagtagtgacacacagactctagtgctacatgatgccggtgttgaccttccttcaagaggaccaaatgatttcagaatttagttttagcagctgaaaatttatttctccctgtaaacgttaaaaacagttttccaaataacatcaacaacacagcaaaaccattgtttcttattctttctaaactacaacgaacacaagaattgaatagtaagatgttaattttttttactataaacatttttagagaagtaaaacatgctgaaaactacacaaattataagcatacaactggactcattatcacagtgaatgcactgtgtgatcgccacataggtaaaaactggaatggtcgtaggcctctccatctgtacccttttccatcatgtcctattccctgtcactacacactaaaactttcctgacttacaataccatgggttatttatgcttgtttttgaatgaaaataaataagttatacagta

SEQ ID NO: 308983 - DNA, 3416 bp, Homo sapiens
ggcggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagcagcagagacaacaggagaagtatgcctcaaatatacactccagggcaagacttttgaggataaggtgacatttcctctacaacccaagcctgatgtcaacctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgttttataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttga

SEQ ID NO: 308984 - DNA, 3531 bp, Homo sapiens
ggcggttctttccggaaattatgactgcagctgttttcactccgctgtgactcagagcgctccgggctgcaggagaggaagcccagcctgttctaccagagaacttgcccaggtcagaggtctgcgtagaagcccttttctgagcatcctctcctctcctcacacctgccactgtcctctgcgttgctgtcgaattaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagcagcagagacaacaggagaagtatgcctcaaatatacactccagggcaagacttttgaggataaggtgacatttcctctacaacccaagcctgatgtcaacctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgttttataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttga

SEQ ID NO: 308985 - DNA, 3729 bp, Homo sapiens
ggcggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccagcagcagagacaacaggagaagtatgcctcaaatatacactccagggcaagacttttgaggataaggtgacatttcctctacaacccaagcctgatgtcaacctcaccattcaccgccttgctgccaagtccttgctccagaccaaggacatgggcctcagggagactccagcaagtgataaaaaagatgcattgaaccttagccttgagtctggtgtcataagctccttcacagctttcattgctatcaataaggagctcaacaagccggttcaggggcctctggctcatagggacgtcccaaggccaattctgttgggtgcttctgccccattgaagataaaatgccaatcaggttttcgaaaggccttacactctgaccgtcctccttctgcatctcagcccagaggggaacttatgtgttataaggccaagacattccagatggacgattacagtctctgtgggttgataagtcacaaggaccagcacagtccaggctttggagagaatcaccttgtgcagctgatttaccaccaaaatgcaaatggttcctgggatctgaatgaagatctagccaagatcctaggtatgagtttggaagaaataatggctgcacagcctgccgagcttgtggattcctcaggctgggccaccatcctggccgtgatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgttttataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttgaaaaaaacaaaaaaaaaaaaaaaaaaaaacaaaaaaaaaaaaaaaaaaaaaaaaaaaaaaagacaaaaaaaacaaaaaacaagcgaaaaaacaaacaaagcagagaagaaagaaggaagcaaagcaaagaagggagaggagagacgcacaagacgcgaaggaggggagaacgaacgcgaaaagcgagaggaagagacaaagagaaaaaaggagagaagcaaaagcagaataggagcgaaagaagggaagaaggggagagacaacgcgggaggagaaaacgagcgacagcgcaaagacgagcagggaggagaaga

SEQ ID NO: 308986 - DNA, 1984 bp, Homo sapiens
ggcggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgttttataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttga

SEQ ID NO: 308987 - DNA, 2099 bp, Homo sapiens
ggcggttctttccggaaattatgactgcagctgttttcactccgctgtgactcagagcgctccgggctgcaggagaggaagcccagcctgttctaccagagaacttgcccaggtcagaggtctgcgtagaagcccttttctgagcatcctctcctctcctcacacctgccactgtcctctgcgttgctgtcgaattaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggatctggctgcacagcaatggtaaggacttgaagtgtgaatgggagcttctggaaaggaaggccgtggcctggatgcgtgcccatgcaggctccaccatgccttcggttgtgaaagctgctattactttcctgaagtcatctgtggatcctgctatctttgccttttgaagataccatccagaaaaagaagtgcctttaatttgctactgtcatttcctctagtatcacttttgctgtgatgatgtgttcttgtgttttataactctttattttttgccataaaagtaaaggatgcttactccacttcgcttctctgctccaggttcactttggatatgatctttcttttcccaacatatgccctcagaaaagtgacagtggtcccagaacctattccctttcttgagggagttcaaaacattcataggcagtaatgttcctcccagggtttccagggaaacaacatgaaaaacaggtgacatgaactacagactaaagattgcagcatttatgttagagaatgcttgaattagagaattttctgcattatctttgtctgttcactttctatcttatatacttatcagggccatactggtaagcttgcgtaggaggagttagagggaagttgaaagccaacatctggatcaatgtaatgtcaagatcacaaagacagagactgcaggggtccactgtgagaggtgacactgttggggaccttcctgattcattcttcttgggctttgctagcctgtacaacctacatgtcttttcttccactgcctgaaagacttgggttgaactataactgttggagagagatgttcctctttaatcatgaaacaccttaagaagtctataatgcaatccttagtcctaccctgaacctatgtgtcctctaagtcaggccctgatctagtgcagtaaagggaagggtgggcttaatgggagctttgcctgggacctgaacctggagcacttaccgcattaggaagaaaggagctccccgtaatcgttcctgacccttgtgtctcatataccctatcctggtggaaatgaccctatttgatatgctgtcccttaaaataacttgtatcaatattaaaatgactatttctaccctttga

SEQ ID NO: 308988 - DNA, 1743 bp, Homo sapiens
ggcggttctttccggaaattatgactgcagctgttttcactccgctgtgactcagagcgctccgggctgcaggagaggaagaaatcttgcatcaccatggtgcacttctgtggcctactcaccctccaccgggagccagtgccgctgaagagtatctctgtgagcgtgaacatttacgagtttgtggctggtgtgtctgcaactttgaactacgagaatgaggagaaagttcctttggaggccttctttgtgttccccatggatgaagactctgctgtttacagctttgaggccttggtggatgggaagaaaattgtagcagaattacaagacaagatgaaggcccgcaccaactatgagaaagccatctcccagggccaccaggccttcttattggagggggacagcagctccagggatgtcttctcttgcaatgtgggtaacctccaacctgggtcgaaggcggcagtcaccctgaagtatgtgcaggagctgcctctggaagcagatggggctctgcgctttgtgctcccagctgtcctgaatcctagataccagttctctgggtcgtctaaggacagttgccttaatgtgaagactcctatagtccctgtggaggacctgccctacacactcagcatggtcgccaccatagattcccagcatggcattgagaaggtccaatccaactgccccttgagtcctaccgagtacctaggagaggacaagacttctgctcaggtttccctggctgctggacacaagtttgatcgggacgtggaactcctgatttactacaatgaggtgcatacccccagcgtggttttggagatggggatgcctaacatgaagccaggtcatttgatgggagatccatctgcaatggtgagtttctatccaaatatcccagaagatcaaccatcaaatacctgtggagagtttatctttctcatggaccgctcgggaagtatgcagagccccatgagtagccaggatacatctcagctgcgaatacaggcagccaaggaaacactgattttgctgctgaagagtttacctataggctgttatttcaacatctatggatttggctcttcctatgaggcatgctttccggagagtgtgaagtacactcagcaaacaatggaggaggctctggggagagtgaagcttatgcaggccgacctagggggcactgaaatcttggcaccactccagaacatttacaggggaccctccatcccaggccaccccctacagctttttgtctttacagatggagaagttacagacacgtttagtgtaattaaagaagttaggatcaacagacagaaacacaggtgtttctcatttggtattggagaaggcacctccaccagcctaataaaaggtattgcccgggcatcagggggcacctcagaatttatcacaggcaaagacaggatgcagtccaaggctctcaggactctgaaacgctctctgcagcctgtggtagaggatgtctctctgagctggcatttgcctcctggtctgtctgctaaaatgctttccccagaacagactgtcatctttaggggtcagagattaatcagctatgcccagctgaccgggaggatgccaccagcagagacaacaggagaagtatcccgcaataccaagggcgagaggaaaagcaagtgccaaggtcctgagacacgaagagatgggcgaggcctgctttgcagcaaacgaatccacggctct

SEQ ID NO: 308989 - DNA, 609 bp, Homo sapiens
  misc_feature (2)..(2): n is a, c, g, or t
  misc_feature (5)..(5): n is a, c, g, or t
  misc_feature (7)..(7): n is a, c, g, or t
gnagngnacagaaggcagttcacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagccatacagccatttaggtaacagccatttaggtaacagccatttaggtaacagccatttaggtaacagccatttaggtaacaagcattaggtaaggtacgaactcgaattcgaatc

SEQ ID NO: 308990 - DNA, 5671 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (536)..(536): n is a, c, g, or t
gnagngnacagaaggcagttcacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattacngacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatatgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtttggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcaggagatagccctcctttgtccttctcccaaactaatgtgcagatgagcagcacggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgctcaggatatccaggaaaataactttgcagagagcttagtgatgacaaccactgtcagccacaatacgactatgccattcaggatttcaatgacttttaagaacaatagcccttcaggcggcgaaacgaagtgtgtcttctggaacttcaggcttgccaacaacacaggggggtgggacagcagtgggtgctatgttgaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaaggaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattataaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaa

SEQ ID NO: 308991 - DNA, 5611 bp, Homo sapiens
attctagctcggtacccacaccacctgagtcaagaggaactatagtgtttttaataacataatctcagaagtgccataccatcacctctaccttattctgttgattacatagaccaatcctagtacaatataagaaggtagtacaaaagggtttgaatacctagtggtagggatgggcaaaggtcatcttggaggctagctaccttatacttatcatcatagacatctggtggctattagctattaggcatgactatctaaaagatgacttagccattcatcactcaaccgtcacagcagtcatctttcagattgtcatagctaatagcatggtgatgcatacatgcaaatatcaattttatgcagtgctattgaacttctcagaaaggtaatataaagtcagattcggatgttcttcaagaatgaatacctgcaggctataaatacaaatatggtgaccaccttctccaccttctctctccttgctgttctgattaacgatagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatatgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtttggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcaggagatagccctcctttgtccttctcccaaactaatgtgcagatgagcagcacggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgctcaggatatccaggaaaataactttgcagagagcttagtgatgacaaccactgtcagccacaatacgactatgccattcaggatttcaatgacttttaagaacaatagcccttcaggcggcgaaacgaagtgtgtcttctggaacttcaggcttgccaacaacacaggggggtgggacagcagtgggtgctatgttgaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaaggaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattataaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaa

SEQ ID NO: 308992 - DNA, 5504 bp, Homo sapiens
  misc_feature (369)..(369): n is a, c, g, or t
ataatcccagcactttgggaggccgagatgggcggatcacttgaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattacngacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatatgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtttggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcaggagatagccctcctttgtccttctcccaaactaatgtgcagatgagcagcacggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgctcaggatatccaggaaaataactttgcagagagcttagtgatgacaaccactgtcagccacaatacgactatgccattcaggatttcaatgacttttaagaacaatagcccttcaggcggcgaaacgaagtgtgtcttctggaacttcaggcttgccaacaacacaggggggtgggacagcagtgggtgctatgttgaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaaggaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattataaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaa

SEQ ID NO: 308993 - DNA, 5769 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (536)..(536): n is a, c, g, or t
gnagngnacagaaggcagttcacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattacngacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatatgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtttggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcaggagatagccctcctttgtccttctcccaaactaatgtgcagatgagcagcacggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgctcaggatatccaggaaaataactttgcagagagcttagtgatgacaaccactgtcagccacaatacgactatgccattcaggatttcaatgacttttaagaacaatagcccttcaggcggcgaaacgaagtgtgtcttctggaacttcaggcttgccaacaacacaggggggtgggacagcagtgggtgctatgttgaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaaggaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattataaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaattgcacgcatattagagttaaccatgtactattgatacagcaacgctacattgcaaataaaagtccgatcccaaaaggagaatgagacaaaaatagag

SEQ ID NO: 308994 - DNA, 6111 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (536)..(536): n is a, c, g, or t
  misc_feature (6111)..(6111): n is a, c, g, or t
gnagngnacagaaggcagttcacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattacngacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatatgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtttggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcaggagatagccctcctttgtccttctcccaaactaatgtgcagatgagcagcacggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgctcaggatatccaggaaaataactttgcagagagcttagtgatgacaaccactgtcagccacaatacgactatgccattcaggatttcaatgacttttaagaacaatagcccttcaggcggcgaaacgaagtgtgtcttctggaacttcaggcttgccaacaacacaggggggtgggacagcagtgggtgctatgttgaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaaggaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattataaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaaaaaaaaaaaaaaaaaaaaaaaaaaaaaaaaaaaaaaaaaaaaaggggggggccccaaaaaattaccccgcggggggccccatttgccaccccttttttttgcaaagggggcccccaaaggggggccgagcgaataaaaacgcagagacagaggggcgccgaggctgtaaaaacacagcgtggcgtggcgcgggggaacgcacgcggctagtgtgggagaccttcttgggggaaagagaacccctcattcgtggtgtggcgtggcagcctatttcggcgggcacaaccctcccctcgaagagagattaagacgccccggaggggacaaatacacatctgacggtgttttggtgctacacccaacgcgaaatatgcatcgcggcaaaaaatttggtcccaggaaattatttagaacattcttaccgaccgtgtataataaan

SEQ ID NO: 308995 - DNA, 3652 bp, Homo sapiens
agttccgattacagaagtcaggttcatgtggaaagcagagaggggctttggaaaatcaagggcaaaattaagaaattgggtagttctgaaaaggtgacggaaagtaaaggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcaggagatagccctcctttgtccttctcccaaactaatgtgcagatgagcagcacggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgctcaggatatccaggaaaataactttgcagagagcttagtgatgacaaccactgtcagccacaatacgactatgccattcaggatttcaatgacttttaagaacaatagcccttcaggcggcgaaacgaagtgtgtcttctggaacttcaggcttgccaacaacacaggggggtgggacagcagtgggtgctatgttgaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaataaaaataattgttatgtttctgtttgttccctccccctcccccttgtgtgataccacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaaggaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattataaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaattgcacgcatattagagttaaccatgtactattgatacagcaacgctacattgcaaataaaagtccgatcccaaaaggagaatgagacaaaaatagag

SEQ ID NO: 308996 - DNA, 5716 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (536)..(536): n is a, c, g, or t
gnagngnacagaaggcagttcacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattacngacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatatgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtttggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcaggagatagccctcctttgtccttctcccaaactaatgtgcagatgagcagcacggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgctcaggatatccaggaaaataactttgcagagagcttagtgatgacaaccactgtcagccacaatacgactatgccattcaggatttcaatgacttttaagaacaatagcccttcaggcggcgaaacgaagtgtgtcttctggaacttcaggcttgccaacaacacaggggggtgggacagcagtgggtgctatgttgaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctgggttcatccacacctgtgttttctatgagttctccaatatcaaggagatttaacaatttgtttggtaaaacaggaacgtataatgtttccaccccagaagcaaccagctcatccctggaaaactcatccagtgcttcttcgttgctcaactaagaacaggataatccaacctacgtgacctcccggggacagtggctgtgcttttaaaaagagatgcttgcaaagcaatggggaacgtgttctcggggcaggtttccgggagcagatgccaaaaagactttttcatagagaagaggctttcttttgtaaagacagaatacacatgtgtatagtatttaagtgaaactcaagccctcaaggcccaacttctctgtctatattgtaatatagaatttcgaagagacattttcactttttacacattgggcacaaagataagctttgattaaagtagtaagtaaaaggctacctaggaaatacttcagtgaattctaagaaggaaggaaggaaggaaggaaggaaagaagggagggaaacagggagaaagggaaaaagaagaaaaagagaaagatgaaaataggaacaaataaagacaaacaacattaagggccatattgtaagatttccatgttaatgatctaatataatcactcagtgcaacattgagaatttttttttaatggctcaaaaatggaaactgaaagcaagtcatggggaatgaatactttgggcagtatcttcctgatgtcttcttagctaagaggaggaaaaaaaggctgaaaaaatagggaggaaattccttcatcagaacgacttcaagtggataacaatatttataagaaatgaatggaaggaaatatgatcctcctgagactaactttgtatgttaaggtttgaactaagtgaatgtatctgcagaggaagtattataaagatatgtcattagatccaagtgctgattaaatttttatagtttatcagaaaagccttatattttagtttgttccacattttgaaagcaaaaaatatatatttgatatacccttcaattgccaaatttgatatgttgcactgaagacagaccctgtcatatatttaatggcttcaagcaggtacttctctgtgcattatagaatagattttaataatcttatagcattgtatattattattgctgttgtcactgttattattattgtggatactggcccttggtgtgttgcatagctccctatgtattctctgtttccatctttaagttcccagaccaatatacattaagagttttgcatggtctaaattgtgtttattccaaccacgtggaaagctcctggaaagaaattttacattcggttgttctgtgctcctaatgacacttgaccttgttgaacaaatggcagagcctttcccaaggatttgattgtttgtgaattatctgcatgtgtgcttttttttggtgtgtatttcattaaaaaatataaatatttatgaaaattgcacgcatattagagttaaccatgtactattgatacagcaacgctacattgcaaataaaagtccgatcccaaaaggagaatgagacaaaaatagag

SEQ ID NO: 308997 - DNA, 4332 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (536)..(536): n is a, c, g, or t
  misc_feature (4151)..(4151): n is a, c, g, or t
  misc_feature (4302)..(4302): n is a, c, g, or t
gnagngnacagaaggcagttcacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattacngacattttgagcataaatgtgacaacagtctgcagacctgctggaaatgaaatctggtgctcctgcgagacaggttatgggtggcctcgggaaaggtgtcttcacaatctcatttgtcaagagcgtgacgtcttcctcccagggcaccattgcagttgccttaaagaactgcctcccaatggacctttttgcctgcttcaggaagatgttaccctgaacatgagagtcagactaaatgtaggctttcaagaagacctcatgaacacttcctccgccctctataggtcctacaagaccgacttggaaacagcgttccggaagggttacggaattttaccaggcttcaagggcgtgactgtgacagggttcaagtctggaagtgtggttgtgacatatgaagtcaagactacaccaccatcacttgagttaatacataaagccaatgaacaagttgtacagagcctcaatcagacctacaaaatggactacaactcctttcaagcagttactatcaatgaaagcaatttctttgtcacaccagaaatcatctttgaaggggacacagtcagtctggtgtgtgaaaaggaagttttgtcctccaatgtgtcttggcgctatgaagaacagcagttggaaatccagaacagcagcagattctcgatttacaccgcacttttcaacaacatgacttcggtgtccaagctcaccatccacaacatcactccaggtgatgcaggtgaatatgtttgcaaactgatattagacatttttgaatatgagtgcaagaagaaaatagatgttatgcccatccaaattttggcaaatgaagaaatgaaggtgatgtgcgacaacaatcctgtatctttgaactgctgcagtcagggtaatgttaattggagcaaagtagaatggaagcaggaaggaaaaataaatattccaggaacccctgagacagacatagattctagctgcagcagatacaccctcaaggctgatggaacccagtgcccaagcgggtcgtctggaacaacagtcatctacacttgtgagttcatcagtgcctatggagccagaggcagtgcaaacataaaagtgacattcatctctgtggccaatctaacaataaccccggacccaatttctgtttctgagggacaaaacttttctataaaatgcatcagtgatgtgagtaactatgatgaggtttattggaacacttctgctggaattaaaatataccaaagattttataccacgaggaggtatcttgatggagcagaatcagtactgacagtcaagacctcgaccagggagtggaatggaacctatcactgcatatttagatataagaattcatacagtattgcaaccaaagacgtcattgttcacccgctgcctctaaagctgaacatcatggttgatcctttggaagctactgtttcatgcagtggttcccatcacatcaagtgctgcatagaggaggatggagactacaaagttactttccatatgggttcctcatcccttcctgctgcaaaagaagttaacaaaaaacaagtgtgctacaaacacaatttcaatgcaagctcagtttcctggtgttcaaaaactgttgatgtgtgttgtcactttaccaatgctgctaataattcagtttggagcccatctatgaagctgaatctggttcctggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggctttgatcaagagcccctctcaggatgagatgctccctacatacctgaaggatctttctattagcatagacaaagcggaacatgaaatcagctcttctcctgggagtctgggagccattattaacatccttgatctgctctcaacagttccaacccaagtaaattcagaaatgatgacgcacgtgctctctacggttaatgtcatccttggcaagcccgtcttgaacacctggaaggttttacaacagcaatggaccaatcagagttcacagctactacattcagtggaaagattttcccaagcattacagtcaggagatagccctcctttgtccttctcccaaactaatgtgcagatgagcagcacggtaatcaagtccagccacccagaaacctatcaacagaggtttgttttcccatactttgacctctggggcaatgtggtcattgacaagagctatctagaaaacttgcagtcggattcgtctattgtcaccatggctttcccaactctccaagccatccttgctcaggatatccaggaaaataactttgcagagagcttagtgatgacaaccactgtcagccacaatacgactatgccattcaggatttcaatgacttttaagaacaatagcccttcaggcggcgaaacgaagtgtgtcttctggaacttcaggcttgccaacaacacaggggggtgggacagcagtgggtgctatgttgaagaaggtgatggggacaatgtcacctgtatctgtgaccacctaacatcattctccatcctcatgtcccctgactccccagatcctagttctctcctgggaatactcctggatattatttcttatgttggggtgggcttttccatcttgagcttggcagcctgtctagttgtggaagctgtggtgtggaaatcggtgaccaagaatcggacttcttatatgcgccacacctgcatagtgaatatcgctgcctcccttctggtcgccaacacctggttcattgtggtcgctgccatccaggacaatcgctacatactctgcaagacagcctgtgtggctgccaccttcttcatccacttcttctacctcagcgtcttcttctggatgctgacactgggcctcatgctgttctatcgcctggttttcattctgcatgaaacaagcaggtccactcagaaagccattgccttctgtcttggctatggctgcccacttgccatctcggtcatcacgctgggagccacccagccccgggaagtctatacgaggaagaatgtctgttggctcaactgggaggacaccaaggccctgctggctttcgccatcccagcactgatcattgtggtggtgaacataaccatcactattgtggtcatcaccaagatcctgaggccttccattggagacaagccatgcaagcaggagaagagcagcctgtttcagatcagcaagagcattggggtcctcacaccactcttgggcctcacttggggttttggtctcaccactgtgttcccagggaccaaccttgtgttccatatcatatttgccatcctcaatgtcttccagggattattcattttactctttggatgcctctgggatctgaaggtacaggaagctttgctgaataagttttcattgtcgagatggtcttcacagcactcaaagtcaacatccctggaagctcgtgccgaattcggcagggantccatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatngtgccatcaagaaggtggtgaagcaggcgt

SEQ ID NO: 308998 - DNA, 1088 bp, Homo sapiens
  misc_feature (2)..(2): n is a, c, g, or t
  misc_feature (5)..(5): n is a, c, g, or t
  misc_feature (7)..(7): n is a, c, g, or t
  misc_feature (536)..(536): n is a, c, g, or t
gnagngnacagaaggcagttcacctctgctcccgacagcctgggaacccgcaagagccccagcatttgaagtctggtcttgtgaaaccccaccctcctctggctgtgtgattgaatgggatgccctcgaggttcacctcacctgagagggttttgggcagatcagcagtaaggtgttaaattttagaagcctgaaaactccagaagagaaaggccaaccaactcaaacttgaagacatgaaatccccaaggagaaccactttgtgcctcatgtttattgtgatttattcttccaaagctgcactgaactggaattacgagtctactattcatcctttgagtcttcatgaacatgaaccagctggtgaagaggcactgaggcaaaaacgagccgttgccacaaaaagtcctacggctgaagaatacactgttaatattgagatcagttttgaaaatgcatccttcctggatcctatcaaagcctacttgaacagcctcagttttccaattcatgggaataacactgaccaaattacngacattttgagcataaatgtgacaacagataaactactgggtcctcttccctgtgtcctcctcccttggtatatcaatggacacaacaaggactggttcaagatattaagatgggatgacttcaagaggcttcaccatcttaaaaacttgggttaacaagcttctcaattaaaatgcaattgaccttggaaagtttaatttatccttccagaaagactggtcattcacacatagagggggtgaatcttttctgatagtgatctatgaaacaggtttgacaaaagtggatacttcaatgtggcagagaaagcctcaggctcatggacctcaggaccagcagggaacagctaagaggagttggcctaaaagaggaagtgaatgggatgggtgggcaatgaaggttaggcctactgaccatggcactaatgtctaagcatccaaactttcaccatcttcctttttccatccttccctcgcctcattcttccaacagcctaccttatgatccttttttagtaatggcaaataaaactgaggatatttaaaaccgga

SEQ ID NO: 308999 - DNA, 440 bp, Homo sapiens
agaataaatgattggatgtcttgagacagactgtctgagctcctgagtatcagagcaatcttttacttagtaggcaagtgaaatgactcaccgagacggatgtgtgattctgtgacttcacagccttcctgaatgaagcctctatcagtaaactctgcagccagaggtttcttattttaaatggtgaccaaaggtttgcttggtggtttgtatgatgcttgtcataaagtgatcccaagatatggccaggtccttcataataaactactgggtcctcttcccttgggcagataaactactgggtcctcttccctgtgtcctcctcccttggtatatcaatggacacaacaaggactggttcaagatattagtaagtaccagatacccttctctttggcattataggtcaggaaataggaaacaggtacatgcctgcatca

SEQ ID NO: 309000 - DNA, 474 bp, Homo sapiens
cctagacatttccctgagtaaattttttgcacatttcatctagtctacttctcggaggacccaggctgacatagataggaattacttcttcagaaatctaatgcccacagttaacaaaatagacagaagataattttacctagtgtgattaggaatatgtggtttttactctgcttcagatcttttgatacacctatttctcgactttgatatatgacattcatcttgctttatttttcagttccggaagggttacggaattttaccaggcttcaagggcgtgactgtgacagggttcaagtaagaatactttaatttgatcatttctaatttatggctgggatccatatggtagtgaaggaggtaaaccccctagagaggcattattcatgtggaatcctcagcaggagcagtttggtagaggtgaaaaaagtacctcaccccttacagatgtacctgtttaaaagaaagaga

SEQ ID NO: 309001 - DNA, 409 bp, Homo sapiens
aggggctttggaaaatcaagggcaaaattaagaaattgggtagttctgaaaaggtgacggaaagtaaaggtaaatgtgaattcaaacatcaaaattctaccttggcctgaccgtatttctactatattgtctcttccttgcaattatccctttatttcaatgtttccaacacaggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggtgatccttaaagcttccactctgag

SEQ ID NO: 309002 - DNA, 424 bp, Homo sapiens
aaattctaccttggcctgaccgtatttctactatattgtctcttccttgcaattatccctttatttcaatgtttccaacacaggggaaaacatcacatgccaggatcccgtaataggtgtcggagagccggggaaagtcatccagaagctatgccggttctcaaacgttcccagcagccctgagagtcccattggcgggaccatcacttacaaatgtgtaggctcccagtgggaggagaagagaaatgactgcatctctgccccaataaacagtctgctccagatggctaaggtgatccttaaagcttccactctgagctcttggtggggcgatctatctggctgatcatatttctcagcacttaggaaaatgggtttggtgctgctttgtgttgctccaaaactacttttatttgtgtatttc

SEQ ID NO: 309003 - DNA, 614 bp, Homo sapiens
actggtatcagagcaatgtagtcttgagcaagacaactgttttccgtatagatggtattaaaaacttcccaatattttaccgtgaagtacttcttaattaattttaaagtaataaattttctttggccttatctaaaaatccatgatcctgtttatgttccacttaaaataatacactaattcccttgcttttcattagtaggttgaaatttgaataagcagcaggaggtggagcctcagcttagcctgaggtgaacaatgagcacatacagtggtttgcagggcaaacccactagaagcctatttcctgaaaatagactgaaaatccttgtaggactaaactcatccttagggaatagagccaggtacagcaagtctggtgcagttgcaaacctttagtcttccaaagggaaaatcaattctatgtgaagtctgttacttggattttatatccaggccagcagtacaccctcagccccttcttctctccaggtagaccacggtacaagacattaagctaaagaactcaataggattcttaggtcatgtaggataaacttccttctcaacccttttatcttcaaatattaatgctaagagggtagcctggagct

SEQ ID NO: 309004 - DNA, 2420 bp, Homo sapiens
atcaaggtctatcttcaggttccgaagagatttaaagggcttttttcccttctgcgtatcgtcttctatatattttattagtgtcaaggcttttctgtgaaggacaagtagaaactgtgcaaggaaagtactgctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaacattgttatatatcttttctcctaaatggagaattttgaataaaatatatttgaaattttaaaaacacaaaacaaaaaacacacaaacccaaaccccacacacaaacacaaacacaacaaaacagcgcggccctcctcataccacactcccacacaaaggccaccaaaccaccacaccccacccaaactatttcttctaaaacaatacgaaatcaccacataatattagaatatatctcaaatcaatatacaacacaaacatattcacaaaacaatgcataaactacaacaactataaccatcctataaaaacactctgcaacacaactatacaaaactattttatcatagcgagcacacaacaaatcgcagatttactaatggctgaccaccaatactttgtggaacccaaactacattaaacatcagaccacgacatatataaaacagctctctatcagggactcaataatatacaacaatgtcactcagagaggatacaaaagaggcgtccaacaaccacatagagctattatattgaattgactaggttgtcgcgacagcc

SEQ ID NO: 309005 - DNA, 2561 bp, Homo sapiens
  misc_feature (2550)..(2550): n is a, c, g, or t
tcagaacattatgcctttttctgactccagcagagagaaaatgctccaggttatgtgaagcagaatcatcatttaaatatgagtcagggctctttgtacaaggcctgctaaaggattcaactggaagctttgtgctgcctttccggcaagtcatgtatgctccatatcccaccacacacatagatgtggatgtcaatactgtgaagcagatgccaccctgtcatgaacatatttataatcagcgtagatacatgagatccgagctgacagccttctggagagccacttcagaagaagacatggctcaggatacgatcatctacactgacgaaagctttactcctgatttgaatatttttcaagatgtcttacacagagacactctagtgaaagccttcctggatcaggtctttcagctgaaacctggcttatctctcagaagtactttccttgcacagtttctacttgtccttcacagaaaagccttgacactaataaaatatatagaagacgatacgcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaactgattaatcagtttacacaatctattgagatgatcatgtgtttttttgttttagttttgtatatgtgatgaatcacatttattgatttgcttatgttgaaccaaccttgcatcttaagaataaagcccacttggtcatggtagactagctttttgatatgccgctggattgtgtttgctagtgttatgttgaggattttgtgtaactgattgggntcctctagatc

SEQ ID NO: 309006 - DNA, 2899 bp, Homo sapiens
tcagaacattatgcctttttctgactccagcagagagaaaatgctccaggttatgtgaagcagaatcatcatttaaatatgagtcagggctctttgtacaaggcctgctaaaggattcaactggaagctttgtgctgcctttccggcaagtcatgtatgctccatatcccaccacacacatagatgtggatgtcaatactgtgaagcagatgccaccctgtcatgaacatatttataatcagcgtagatacatgagatccgagctgacagccttctggagagccacttcagaagaagacatggctcaggatacgatcatctacactgacgaaagctttactcctgatttgaatatttttcaagatgtcttacacagagacactctagtgaaagccttcctggatcaggtctttcagctgaaacctggcttatctctcagaagtactttccttgcacagtttctacttgtccttcacagaaaagccttgacactaataaaatatatagaagacgatacgcagaagggaaaaaagccctttaaatctcttcggaacctgaagatagaccttgatttaacagcagagggcgatcttaacataataatggctctggctgagaaaattaaaccaggcctacactcttttatctttggaagacctttctacactagtgtgcaagaacgagatgttctaatgactttttaaatgtgtaacttaataagcctattccatcacaatcatgatcgctggtaaagtagctcagtggtgtggggaaacgttcccctggatcatactccagaattctgctctcagcaattgcagttaagtaagttacactacagttctcacaagagcctgtgaggggatgtcaggtgcatcattacattgggtgtctcttttcctagatttatgcttttgggatacagacctatgtttacaatataataaatattattgctatcttttaaagatataataataggatgtaaacttgaccacaactactgtttttttgaaatacatgattcatggtttacatgtgtcaaggtgaaatctgagttggcttttacagatagttgactttctatcttttggcattctttggtgtgtagaattactgtaatacttctgcaatcaactgaaaactagagcctttaaatgatttcaattccacagaaagaaagtgagcttgaacataggatgagctttagaaagaaaattgatcaagcagatgtttaattggaattgattattagatcctactttgtggatttagtccctgggattcagtctgtagaaatgtctaatagttctctatagtccttgttcctggtgaaccacagttagggtgttttgtttattttattgttcttgctattgttgatattctatgtagttgagctctgtaaaaggaaattgtattttatgttttagtaattgttgccaactttttaaattaattttcattatttttgagccaaattgaaatgtgcacctcctgtgccttttttctccttagaaaatctaattacttggaacaagttcagatttcactggtcagtcattttcatcttgttttcttcttgctaagtcttaccatgtacctgctttggcaatcattgcaactctgagattataaaatgccttagagaatatactaactaataagatctttttttcagaaacagaaaatagttccttgagtacttccttcttgcatttctgcctatgtttttgaagttgttgctgtttgcctgcaataggctataaggaatagcaggagaaattttactgaagtgctgttttcctaggtgctactttggcagagctaagttatcttttgttttcttaatgcgtttggaccattttgctggctataaaataactgattaatataattctaacacaatgttgacattgtagttacacaaacacaaataaatattttatttaaaattctggaagtaatataaaagggaaaatatatttataagaaagggataaaggtaatagagcccttctgccccccacccaccaaatttacacaacaaaatgacatgttcgaatgtgaaaggtcataatagctttcccatcatgaatcagaaagatgtggacagcttgatgttttagacaaccactgaactagatgactgttgtactgtagctcagtcatttaaaaaatatataaatactaccttgtagtgtcccatactgtgttttttacatggtagattcttatttaagtgctaactggttattttctttggctggtttattgtactgttatacagaatgtaagttgtacagtgaaataagttattaaagcatgtgtaaacattgttatatatcttttctcctaaatggagaattttgaataaaatatatttgaaattttaaaaacacaaaacaaaaaacacacaaacccaaaccccacacacaaacacaaacacaacaaaacagcgcggccctcctcataccacactcccacacaaaggccaccaaaccaccacaccccacccaaactatttcttctaaaacaatacgaaatcaccacataatattagaatatatctcaaatcaatatacaacacaaacatattcacaaaacaatgcataaactacaacaactataaccatcctataaaaacactctgcaacacaactatacaaaactattttatcatagcgagcacacaacaaatcgcagatttactaatggctgaccaccaatactttgtggaacccaaactacattaaacatcagaccacgacatatataaaacagctctctatcagggactcaataatatacaacaatgtcactcagagaggatacaaaagaggcgtccaacaaccacatagagctattatattgaattgactaggttgtcgcgacagcc

SEQ ID NO: 309007 - DNA, 2880 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309008 - DNA, 3131 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctcccccgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309009 - DNA, 4087 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctgggaaaaaaaaaacaaaaaaaaaaaaaaaaaaaaaaaaaaacgagagagagagagagagagaactagtctcgagtttttttttttttttttttgtttttaattaagagacagggtctcgactgggctcactgcaacctccgcctcccgggctcaagcaattcccccgcctctgcctcccgagtagccggcaccacagccgcccgccaccatgcccgaccaatccctgcagttttagtagagacggagtttcaccatgttggccaggctggtttgaaactcctgatctcaggtgatccaccccactcagccttccaagtagcttggtgtgagtcaccgtgcccagcctgttctctagccttttaaaacactgcacaggtatcttcgggtttaaactcctggcctaaatgatcctcccaccttaccctccaaggaactcggaccacacgcttaagccctatgcccagggattcctttttaattcccttcttcatgccttcgtattacctgagtcgcgctcttgaccccttggggcgtaatcccgcgtcttgccacaattaccgttcttaccacct

SEQ ID NO: 309010 - DNA, 1015 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatataggtaaatatacgttctgcatccaaatgcactttgagattgttacgatttattctgagcaagatctgcattttttgaaagtttgagattgtagttatcttttttgagatgagatactttcacgactttggtatcatctgtcagtttttgcccagtgagttctgcatttgcagctccttgttttggtctgttcgtaactgcagtgttctccatgagtatcaggaaggtagggtttcacttaggagtaagaacagtccccagtccagcagccacccttttcagctgctgttcattgccagttgatgaggtgagtgtcatctgcctctctggacaggccccagtggagaacaccgcaggtactgtaaaccaagtacttttcacagcgtggcctttcaccataattttatatttctccccctaaaatgtggtcttttactttttataggtactttctgaaaaaaaaaaaaatgaca

SEQ ID NO: 309011 - DNA, 1255 bp, Homo sapiens
tcgtccctttcaaagtctccgagttcttcatgcttgttgttgagatttgagatgtttattggtaacattgtcttttttccatccttttttttctttcctaacctggtttcttccagtgcaactgcagatagaagacctgactcgtaaactgcgcacaggagacctgggcatcccccctaaccctgaggacaggttgggaaacagttttaaccagctgacagtaacgcttttacctttttctcaatacgttttactggtggcaacatattgtgtcagttcaataaaatcatagtatgacgactgtaccctgaccactttggggattaaggtttaattagaaatatgtatggtcagtcaacagttagaaaattggaataaaacttaaaaatgttgggagaataaaaagttacaggaaaatggacaactggtttccaattggtaagcatgtagatcttaacctgatttacccacccttaggggacagtgaggtggcccgttaacctgccttttcagtacctgctttggccaaaagcccagggcatagagtttttctcacaggtacacagtgcagggactaaaaatatttttgagcatcactgaacttgagcaagccaggagctctggtcagctcattgctgcagtcttcctgctcatggttttgagatggtttcaaaatcagatgagatttctaaccaacttctttcactgccagttaactttcagccttggccattgccttgggggtgttgggaggggccagaatattctcacctattttgggaaggcatgcaaccaaccctaaattacttttttttttccttaaagggagcgtgggcctcaaacagctgtggtcatgtcatttcagtttgcagtttctctcacctcagaaaaataaattgtgtgggggagatgaacttttttaaactggaattttattagctgattgaacagctaaaattggtcatttaattagaagggcagtaagtctctccctctcactgaattttctcttagtacatacagaatagttgaaaagactttgctttaaaaagtagtgtttttggtttttgttacccagttaatagcttattaaatcaggaagatgatgtaatggctttagaagtcactcactcatgcatctttcttccgccctttgccaggaaacattaacttccttgtttctccatattgactctttaatttgacttactacatttgctatattttacctatagatagattttggttgtagggt

SEQ ID NO: 309012 - DNA, 602 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggcccctgacgagcaggaggctgatctggctggaaaacagcctggaacactggggcggcaccctggtcgtgagctagcaagcactcgcaggaaagagtaccagccctgtcacctggtcgctccggtctcagacggtgggagtgcaacattcttcggtgaagagcacggcaactggcgaagaccatcgcactcgtagggtggaagccgcagggagcactatcgcacgaacgtcgaagcgaagatccaagacaaggacaggccatgcctgcctgaccacgcagaaggattgactgcttaggacgcggacaagcagcatggaagaatggagcgcaccctggtctgaactacaaaatcacagaaggcagtctaggctctggcacctggtgactcccgtcctcagacgtgagatgaccgatcc

SEQ ID NO: 309013 - DNA, 923 bp, Homo sapiens
gtgaggtggccgggctgtgcggcgcaactgtatagactgggggcccactattgctgtccagtccgctggtgtcgggaacaggggtggcgggtgttcagcgctggacggggtgctagctgtgaatgccagcagggcgtgaaagcctcacctgatgacgtgcagcgactcccttctggtcttgaggaaccagaatgggaaccgtaccaaggatagctcctctgcttctacagcaaggcagggttttcatccgggagagacttcccaagtaagaagcggaagaggagccgctggaaccaagacacaatggaacagaagacagtgattccaggaatgcctacagttattccccctggacttactcgagaacaagaaagagcttatatagctgtgaagctacgggaacaggagcagaagggaggacgaagctgaggctccagcagcaggaggagcggcggcggcttgcaggaggccgagactgcggcgcgtggaggaggacaaggagcgcgcgctgggcctgcagcgggaaaagatgcgggagctgcgcgagcggatgctgagcatcctgctgagcaagaagccggacgacagccaacacacacgacgagctgggcgtggcacacgccgacctgctgcagcccgtcctggacatcctgcagaccgatgtcgtccggctgtgtgagcgcgaccacggctgaacgcccctcgggggccaggcccccggccggtggcccccaagggagaagcggggaccaacccaaaagggccgacggggcatcccaaaaaggcgtgaaacggggcagcgtggcgagggggggcccacgcgcagggagggacagacggaccggtcgacgagcgccccgaggatgacacccgagagcaaaggacgcacggacgagaagcagcacgagaccagaaaaagacaa

SEQ ID NO: 309014 - DNA, 555 bp, Homo sapiens
aaggaatgaggttctgatatgttactacatgaatgaactttgaaaacattcatctaactgaaattagccagacaaaaaataatatgctatgattccatttatatgaaatatctagctagaataggcaaattcatggagacaggaagtagaatggtgacttctagggacttagggaagaaaggaatgggaagttactgcttaaagagtttctatctgtggtaataaaaaagttttcaaaatgatggtgataattgtaaactctggtggagaatcataggttttccccttgctgtttgcaggttcagaccctagacaagtatgaccaaatctgcatttgcagcctctcgcagaagctgctttagcactttaacgtttttctctacccagactccccaacctcgaacagccatacagccatttaggtaacagccatttaggtaacagccatttaggtaacagccatttaggtaacagccatttaggtaacagccatttaggtaacagccatttaggtaacagccatttaggtaacatactctcggacagccatgtagt

SEQ ID NO: 309015 - DNA, 301 bp, Homo sapiens
cacccagtcatccaacaggcccgggcgtatctgcttcccagtgtgcccaaacccatctggcagcccactgctgcctccaccttctatgaccacacaacctcagcagcctgaccactcttcccacatctcactcctactgaaaatagaggaggcagaagcaggaagcagaggaccagaatgatctacggaagatgcagcttcgggagttggctcgcttaaatgggacccttcgggaagacgataacaggatcttaagacctggcagaagcaggaagcacgaagcaggaagcggcagaagcgg

SEQ ID NO: 309016 - DNA, 3517 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309017 - DNA, 3541 bp, Homo sapiens
aacccggcgctcgttcccccaccccggccggcgccataggccagccctccgtcaacctcttcaccgcaccctcggacgccccaaggcccccgccgcgctccagcgccgcgcagccaccaccaccaccgatgaaccaggcccccaccctcctgggcaccatggcctcctccaatgggtaaatcagtacctgggaagtacgcctgtgggctctggggtctatcgcctgcatcaaggaaaaggtatgatgccgccaccacctatgggcatgatgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309018 - DNA, 3357 bp, Homo sapiens
gtgaggtggccgggctgtgcggcgcaactgtatagactgggggcccactattgctgtccagtccgctggtgtcgggaacaggggtggcgggtgttcagcgctggacggggtgctagctgtgaatgccagcagggcgtgaaagcctcacctgatgacgtgcagcgactcccttctggtcttgaggaaccagaatgggaaccgtaccaaggatagctcctctgcttctacagcaaggcagggttttcatccgggagagacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309019 - DNA, 4835 bp, Homo sapiens
ttttgaagattttttttttttttaaatttacattgtaggtcatagaccacaactgtttagtgcctttttggcctttttccctttaataatatgtctacaggtcaccagtcaattcctccaaaggttgaatttttaacaaaccttctttgcttcctggataactgggattagaatttagttgatgtagccgatgcctgttggaggtgaagaagtcgggccagtctaacctctagaatactagcttttgcctttcacttctgcaatttgggaggaggttaaactgttgtgaggccttcacatggccaattgggtgctggtaagacttgtttttgtaactagctaagaatgcttaattctagacagctgtggggtgggaattagaaatgtcaagcatgttagaaataaaaccagagcagggtttttcctcccttctattcagttttgaaagaggccctaatgcctgattggttttgcttttgagcccaggttggagggaaatgcatgggttttcttaattaagataatttcttaaaaaggtgttatatcacttaagccactttattgttattttgatgctgcttaacttgcacagtaaaaacatgtttaaaacttttcttgtagacttaaatgtataagatggtagtctaatgagctggggtatgtttgcttttgttcactcttaatggattgtgctaacagtttatacaaatgctagaaacggaggtgtcatttagccgtcattagccatgaacaaacctgacctttttattccatcgtgtgtgtaacgtggtgtgacatggttccctttaggctgaagacagtgggagcagccgagttcagtccttgctctccaactaggcaaggttctctcaactaaaccaagggtataggagtcttgattactttcagtatgtttttttaataacctgatccacatggtctcttcccttcttgcagctgctactaaattttcattcagaatatcaagctatggtcctttttgtaatcttaactcaaaattctaggagtgtaacctctcttttttattaccgcaaaatccagctgtggtaaactgaccattttatcattacatttttttacttgtagcaacagcattttactccttaaaaaaatgagagagagaaaatctgctttctggacttgtaaactctggtggagaatcataggttttccccttgctgtttgcaggttcagaccctagacaagtatgaccaaatctgcatttgcagcctctcgcagaagctgctttagcactttaacgtttttctctacccagactccccaacctcgaacagccagaaaacaggttgtctcctgggccttggacacagccagccaggccattgaaggaaaagcaaagacgaagcgaaccatctctctccattgtgggggccaagtagctgcagtagccttcagtcccagttgcattgggttaaagagctcatacatactatgtgttaggggtacagaagcttttcctcatagggcatgagctctccaagagttaaccttttgcctaaacttggggtttctgtggttcataaagttgggatatgtattttttttcaaatggaagaaaatccgtatttggcaagaagactccaggggatgatactgtccttgccacttacagtccaaagattttccccaaagaatagacattttttcctctcatcacttctagatgcaaaatcttttatttttttcctttctcacacacaccccagacccctaacgttaagccagcttccatctccccattccacacgatcttgagtagcacacgttatggtcggttcctccgaagagtgttgtattagggtctgagaggcagaggggctgggaaagacttgttatagtccgtgtgggaatgagagaagtcggtgcagaatagtaaacgggagtctgtttcccacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309020 - DNA, 3465 bp, Homo sapiens
aacccggcgctcgttcccccaccccggccggcgccataggccagccctccgtcaacctcttcaccgcaccctcggacgccccaaggcccccgccgcgctccagcgccgcgcagccaccaccaccaccgatgaaccaggcccccaccctcctgggcaccatggcctcctccaatgggtaaatcagtacctgggaagtacgcctgtgggctctggggtctatcgcctgcatcaaggaaaaggtatgatgccgccaccacctatgggcatgatgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatataggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309021 - DNA, 3432 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309022 - DNA, 3780 bp, Homo sapiens
ttttgaagattttttttttttttaaatttacattgtaggtcatagaccacaactgtttagtgcctttttggcctttttccctttaataatatgtctacaggtcaccagtcaattcctccaaaggttgaatttttaacaaaccttctttgcttcctggataactgggattagaatttagttgatgtagccgatgcctgttggaggtgaagaagtcgggccagtctaacctctagaatactagcttttgcctttcacttctgcaatttgggaggaggttaaactgttgtgaggccttcacatggccaattgggtgctggtaagacttgtttttgtaactagctaagaatgcttaattctagacagctgtggggtgggaattagaaatgtcaagcatgttagaaataaaaccagagcagggtttttcctcccttctattcagttttgaaagaggccctaatgcctgattggttttgcttttgagcccaggttggagggaaatgcatgggttttcttaattaagataatttcttaaaaaggtgttatatcacttaagccactttattgttattttgatgctgcttaacttgcacagtaaaaacatgtttaaaacttttcttgtagacttaaatgtataagatggtagtctaatgagctggggtatgtttgcttttgttcactcttaatggattgtgctaacagtttatacaaatgctagaaacggaggtgtcatttagccgtcattagccatgaacaaacctgacctttttattccatcgtgtgtgtaacgtggtgtgacatggttccctttaggctgaagacagtgggagcagccgagttcagtccttgctctccaactaggcaaggttctctcaactaaaccaagggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309023 - DNA, 3089 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309024 - DNA, 3317 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggctgacaggaaccatagagcctcacacaagcaggcaggtgtcttgggatgagcccctgggctctgctggggttgtaaacagaaagggcctctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309025 - DNA, 3496 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309026 - DNA, 2705 bp, Homo sapiens
  misc_feature (34)..(34): n is a, c, g, or t
tcggtacctcctggtggtgctgctgtctggtggngctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309027 - DNA, 3318 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtggtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309028 - DNA, 3167 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgcagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309029 - DNA, 2494 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309030 - DNA, 3563 bp, Homo sapiens
  misc_feature (3179)..(3179): n is a, c, g, or t
  misc_feature (3188)..(3188): n is a, c, g, or t
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctcccatccgtctggcgntcctgcagnagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309031 - DNA, 3431 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309032 - DNA, 2082 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagccccaaggcgcatccatggtggtcctcctacacggataggaaacaaggagcagagcagctccgcaaccaccgttcgccagaagaagtatgggaccaagttaccccctgccatggaggaaagatactcaccagaggaggcaaggccgagacaagaagagggggggttcccgggccttggaaccctcacggaaaaggtaagaacgccccgtggccaagaagttggcgacagctgg

SEQ ID NO: 309033 - DNA, 1938 bp, Homo sapiens
  misc_feature (1634)..(1634): n is a, c, g, or t
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcaaaaangaacaacaaccacatgcaagacaacaaaacacaaaagaaaaaaagaaacaacaagtgagcacaaggagaaacacaccacataaacacgaaaacaaacagaaagagagaaagagagcagaacagaaagagaggggaacaggagcgaaacaggaaacagaaaggagaagaagacaaaggggcgagcaagagaagacacaagacaaaaaaaacggagaagagaacgaaagacagagcaggcggacgaagagcgagagaggacaaggagaaaaagaagagagagaagaagaagaagaagacagaaagc

SEQ ID NO: 309034 - DNA, 1743 bp, Homo sapiens
  misc_feature (1637)..(1637): n is a, c, g, or t
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacctgaagnacatagagaaggagtgccatgccaagattatgatccgggggaaagggtctgtgaaagaagggaaggttgggcgccaagatggccagatgttgccaggaagatgcct

SEQ ID NO: 309035 - DNA, 1971 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggctgcgggcatccatgagaaacccaagggcaccacacacacttgaaaaaccaccacacgagaaacagggccagccaggcaagcgcaccccaagagaatacgagaacaaaaaacacaagaagacagaggcaacaaagcaggcaacacagaaaagactgaaaccaagcaggcgaaatgaacactcgaccaaaaaaaaatgaaccaaaatcaactacagaaaaacaaaacaacaacgagaagacacgatcgcacaacgaacaacgcagacaaaaccaccaccaacaaatcaaaaacaaaacaactacattaacacaggatgtgcaaaacaaccacaatagcgacgctggctgactgcgcctcctcccagagag

SEQ ID NO: 309036 - DNA, 599 bp, Homo sapiens
cgagctcggtaccccgttgacacttcaggggcaagggctttggccattcatgtcaagctggttgtgggtttttcaaggtgccatagccacccccaaatatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309037 - DNA, 1891 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggcaggcttcacagatgatcattaggtttgggaatcttaaatagagtctcccttctctcttttcactgttagggagggagagggagtgatgtttttggtgctctgttactttagctgaaggattttctatcaatcttcacaatctgtcttgaaatggttcccatcagccacttcgtgcaggaatccaaggggctaagaaacatacacacacacatacacatacacacacgggcacacacacaggcccactgtgcccagagacccacacgcgcagcaggctgccaggaaacc

SEQ ID NO: 309038 - DNA, 2061 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagccccaaggcgcatccatggtggtcctcctacacggataggaaacaaggagcagagcagctccgcaaccaccgttcgccagaagaagtatgggaccaagttaccccctgccatggaggaaagatactcaccagaggaggcaaggccgagacaagaagagggggggttcccgggccttggaaccctcacggaaaaggtaagaacgccccgtggccaagaagttggcgacagctgg

SEQ ID NO: 309039 - DNA, 1573 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctctggttgtccgcaagaaccactcacgttctcatgtttacaccagagcggccccctggtgagttctggccttgagagttggccttcccgggctgtggggggccttgtgggcccgggtggcccccgtgcccccctttccgctggaggggctggggcgc

SEQ ID NO: 309040 - DNA, 381 bp, Homo sapiens
ggcttgttctagcatgaccttgcatcagtcttatgcatgagaccattcttgattttaaaacccttctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309041 - DNA, 1684 bp, Homo sapiens
gttcacgtagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggttgggaaacagttttaaccagctgacagtaacgcttttacctttttctcaatacgttttactggtggcaacatattgtgtcagttcaataaaatcatagtatgacgactgtaccctgaccactttggggattaaggtttaattagaaatatgtatggtcagtcaacagttagaaaattggaataaaacttaaaaatgttgggagaataaaaagttacaggaaaatggacaactggtttccaattggtaagcatgtagatcttaacctgatttacccacccttaggggacagtgaggtggcccgttaacctgccttttcagtacctgctttggccaaaagcccagggcatagagtttttctcacaggtacacagtgcagggactaaaaatatttttgagcatcactgaacttgagcaagccaggagctctggtcagctcattgctgcagtcttcctgctcatggttttgagatggtttcaaaatcagatgagatttctaaccaacttctttcactgccagttaactttcagccttggccattgccttgggggtgttgggaggggccagaatattctcacctattttgggaaggcatgcaaccaaccctaaattacttttttttttccttaaagggagcgtgggcctcaaacagctgtggtcatgtcatttcagtttgcagtttctctcacctcagaaaaataaattgtgtgggggagatgaacttttttaaactggaattttattagctgattgaacagctaaaattggtcatttaattagaagggcagtaagtctctccctctcactgaattttctcttagtacatacagaatagttgaaaagactttgctttaaaaagtagtgtttttggtttttgttacccagttaatagcttattaaatcaggaagatgatgtaatggctttagaagtcactcactcatgcatctttcttccgccctttgccaggaaacattaacttccttgtttctccatattgactctttaatttgacttactacatttgctatattttacctatagatagattttggttgtagggt

SEQ ID NO: 309042 - DNA, 646 bp, Homo sapiens
tccctctcggttggtgtcttttcctctcaggtcgtctgcgttgttgctctgttgttcctctgctcccgttggccgtgtgttgatcgagcgggcgtgtcgctcggcttgttttagtttaggctgccgtcccctcttgtcgacgcctcctgttttcattcactgaatctggtgtgctctcggctgcctgtcttggcgcccccccgtgtggggtattttgtgtctggtctcggccccccctttcttctttttttttgttttttttttttttttttttttttttttttttttttttttttttttttttttttttttttttttaaaccacactgctcttttattcaatggaacatccccgctttagcgcagtgttgaatctaacaccgaaaaaagcccagagaaatttctgcagataaaccagtgaagagaacgcgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctggg

SEQ ID NO: 309043 - DNA, 653 bp, Homo sapiens
gcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccggtgagcctgggggctggctctcttggtctggcttccccattctctactgcagagactgggagctatggccacgtggtttgggtagagcagacaatggatgtggatggcaacattgttcttccgggatctcaggccagtttggggacttctcacttcgggaagaccttgttcttgtgttctggtcctgtgtcataacccgaagaacaatgttgccactagggggcgcaggcagggacgttggcaggaaatgctctcacgtagtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagc

SEQ ID NO: 309044 - DNA, 1906 bp, Homo sapiens
gggggcacttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaa

SEQ ID NO: 309045 - DNA, 924 bp, Homo sapiens
caggctgtacgccccgggattatgggatgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaaagtgggaatgaaaagatatgagttggaaaagcctcttcgaaccactaatggctacttcccggggggattggccacagttccaaaaccagctttggggcgtggtaaaatccaccctgtttaataaggacccggatcccagcgacaaagccaagggatattctgtagatgggggaataagaggggcaaaacggccttcgaagaatatggaacaaggttagagggacccacagacaacgttgaaccaaa

SEQ ID NO: 309046 - DNA, 1978 bp, Homo sapiens
gggggcacttcacgtgacgccggtgccgggcgaacatggcggcggccaccgggtgagtgctgcgcctccctcgctctttcccgctggcgtggagaggggcatgggtgtcccggccggaccgcggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaa

SEQ ID NO: 309047 - DNA, 1783 bp, Homo sapiens
gggggcacttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaa

SEQ ID NO: 309048 - DNA, 2097 bp, Homo sapiens
gggggcacttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaatggtcctttgtgcgtggcttcccctttattcctttgcagatgagcatttgggaccccgtgcaccctgaaaagatggctcacctggtgtcagtatcaagtcagttccaggaagatggtgctggcagcacaggccctctaacggctgcttctgcctcagactggcctggcgggacaagggcagagtcctcccc

SEQ ID NO: 309049 - DNA, 1415 bp, Homo sapiens
cttgcaccttgggcttcgattgacctcctcctctaacagaagttcaggttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaa

SEQ ID NO: 309050 - DNA, 1648 bp, Homo sapiens
tatgttgtcaaatgcttaattctaggtaattaaggctttacctcacatcgttaacatttttgtggtcagagtatgtgacattgtcaatgtttttcaaaaacacaactacattattatgatctgtagtcactatgctgtacaaaaagatctcttaaacttattcctcctattaaactataattatgtattctttgaccaacatcttccaaaaccccccttttttctaaataccttggtgtctgggtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaa

SEQ ID NO: 309051 - DNA, 1519 bp, Homo sapiens
tgccaccagggctgtttcactgaggcaggagctctggctggtgccccctaccctgcatgccgtgggccttgacatggggccccagcctttgcctccagctgctcccagccgcttccctgtggacagtcttgtctgcattcctggggtccaggttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaa

SEQ ID NO: 309052 - DNA, 1438 bp, Homo sapiens
catcgctttggcatgccgtctgtaggcggatggggtctgtacgggacggctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaagcctcttcgagcactactgctactcccggggcggcatgcgccacagctcctacacctgcatctgcggcagtggtgagaactcagccgtgctacactacggacacgccggagctcccaacgaccgaacgatccagaatggggatatgtgcctgttcgacatgggcggtgagtattactgcttcgcttccgacatcacctgctcctttcccgccaacggcaagttcactgcagaccagaaggccgtctatgaggcagtgctgcggagctcccgtgccgtcatgggtgccatgaagccaggtgtctggtggcctgacatgcaccgcctggctgaccgcatccacctggaggagctggcccacatgggcatcctgagcggcagcgtggacgccatggtccaggctcacctgggggccgtgtttatgcctcacgggcttggccacttcctgggcattgacgtgcacgacgtgggaggctacccagagggcgtggagcgcatcgacgagcccggcctgcggagcctgcgcactgcacggcacctgcagccaggcatggtgctcaccgtggagccgggcatctacttcatcgaccacctcctggatgaggccctggcggacccggcccgcgcctccttccttaaccgcgaggtcctgcagcgctttcgcggttttggcggggtccgcatcgaggaggacgtcgtggtgactgacagcggcatagagctgctgacctgcgtgccccgcactgtggaagagattgaagcatgcatggcaggctgtgacaaggcctttacccccttctctggccccaagtagagccagccagaaatcccagcgcacctgggggcctggccttgcaacctcttttcgtgatgggcagcctgctggtcagcactccagtagcgagagacggcacccagaatcagatcccagcttcggcatttgatcagaccaaacagtgctgtttcccggggaggaaacacttttttaattacccttttgcaggctcccacctttaatctgttttataccttgcttattaaatgagcgacttaaaatgattgaaaataatgctgttctttagtagcaactaaaatgtgtcttgctgtcatttatattccttttcccaggaaagaagcatttctgatactttctgtcaaaaatcaatatgcagaatggcatttgcaataaaaggtttcctaaaa

SEQ ID NO: 309053 - DNA, 976 bp, Homo sapiens
gggggcacttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaagatccattccaaggagcacttcaaggagaagtatgccgtggacgacgtccagtacgtagatgagattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgctgggagctctgactcgcctcgtcttagagcttgggaccaaggaggtatcctgaaagatgaatgggcatcggctgtggaaaaagaaggagtaggagagagtgaccctggcaaaaggaccactcgttcacagaaacaagagaaagggtggtggctctgtgtggccagtgcggagccagggagcagagcccgagaacagttggagagacaggcagtggctggccgagtgtttaagacggatatggagctggaggttctgcgctataccaataaaatctccagcgaggcccaccgtgaggtaatgaaggctgtaaaagtgggaatgaaagaatatgagttggaaaggtaagccaccatgtttctccgggtaaaattaaaaggtaaaaaacagtaaa

SEQ ID NO: 309054 - DNA, 692 bp, Homo sapiens
gggggcacttcacgtgacgccggtgccgggcgaacatggcggcggccaccggaccctcgttttggctggggaatgaaaccctgaaggtgccgctggcgctctttgccttgaaccggcagcgcctgtgtgagcggctgcggaagaaccctgctgtgcaggccggctccatcgtggtcctgcagggcggggaggagactcagcgctactgcaccgacaccggggtcctcttccgccaggagtccttctttcactgggcgttcggtgtcactgagccaggctgctatggtgtcatcgatgttgacactgggaagtcgaccctgtttgtgcccaggcttcctgccagccatgccacctggatgggaaaattgccagcgtcctgacgtcacagaagccctctgtcctcctcactttgcgtggcgtcaacacggacagcggcagtgtctgcagggaggcctcctttgacggcatcagcaagttcgaagtcaacaataccattcttcacccagagatcgttgagtgccgagtgtttaagacggatatggagctggaggttctgcgctataccaataaaatctccagcgaggcccaccgtgaggtaatgaaggctgtaaaagtgggaatgaaagaatatgagttggaaaggtaagccaccatgtttctccgggtaaaattaaaaggtaaaaaacagtaaa

SEQ ID NO: 309055 - DNA, 394 bp, Homo sapiens
atgaagctgcttgttcccggcattgtcctttttgacccttttaaatgtctctgcagcaccttgcaccttgggcttcgattgacctcctcctctaacagaagttcaggtttggcctcttggtttgacctgatgggcccccccagctccccttatcccctggcctgcagggaagaggagcttgtggtagacagtggtccccacctgtccacccagcctatacccttgggaccctggtccagctggatggttgggccaggacccctccaggtgtggctactcggggtgcctggcctggggtctgtcccatttgggctcagccttggtctcagacctccctccacctccccagatcagggccaggccgcctgctgcctgcagtaagagtgtgtggggt

SEQ ID NO: 309056 - DNA, 387 bp, Homo sapiens
gtgagtgctgcgcctccctcgctctttcccgctggcgtggagaggggcatgggtgtcccggccggaccgcgggtgagagcgtcagccggggtcgctgaatgccgcgggtaggcgcctcttcccgttggcccggagtcccagcgccggtcggcgagctgcacgctccgagtcagggtcagcgcgggggccgcagctcctctccaccctcctggctggctccggccccacctgcccgcgtctggcggccccaccgtgtgcggctgcggtgggggctggggtcgacacgcatgttcgctgccaagacccccgggtaggagggcggcgttgcgaggaccccagggacccgggcgcttcccggaggaggcggtattcgagacggacttggaa

SEQ ID NO: 309057 - DNA, 1630 bp, Homo sapiens
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaa

SEQ ID NO: 309058 - DNA, 912 bp, Homo sapiens
  misc_feature (685)..(685): n is a, c, g, or t
  misc_feature (689)..(689): n is a, c, g, or t
  misc_feature (699)..(699): n is a, c, g, or t
  misc_feature (701)..(701): n is a, c, g, or t
  misc_feature (745)..(745): n is a, c, g, or t
  misc_feature (773)..(773): n is a, c, g, or t
  misc_feature (819)..(819): n is a, c, g, or t
  misc_feature (900)..(900): n is a, c, g, or t
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccacacactgtgaacacagatganctantcattatacnangcctgatacactctcgcacctgagctacacccactacgggactnacactgttggcacatacggtacactctncttcggcactacaactccacgcgtaatgtctcccgctatttatcgntcgcctacacgggacaaacgcctagtcacacacaattataaatatcctacccagccattaggtattgggattataggtganattattaaaaaa

SEQ ID NO: 309059 - DNA, 587 bp, Homo sapiens
ttaattaaatatcccaacccatgcaggcggctcctgttgccccattccaattcaaaggcacatttaattccatgtggtaacatggtgtattatctacacctctcatgaacagcagccatggaccaggtcctcccagaaaggagagcgatgagggtccagggatatccattacccaggaagcaagacatggccagagaggaagggaaggagtgctgtgctgcagccagacagctggagctcatgaacagccccaaaatggaaaagttaatgaaagtcacagtgttgtctcttataaaaattttaaatgggctgggagcggtggcttacacctgtaatcccagcactttacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaa

SEQ ID NO: 309060 - DNA, 1722 bp, Homo sapiens
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaaaaaacacaccccacaacccacacaccacacacccccgccgccacccccgcggccgcaacaggccaccacgcccccgggccaagggcccccag

SEQ ID NO: 309061 - DNA, 1908 bp, Homo sapiens
  misc_feature (1908)..(1908): n is a, c, g, or t
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggtagatgcccccgcgagacgggttagggaaagcggaggaggaaagcgagggggtggggggcttcccgggacgataacctggcagtggaaggaaagaagcatggtctactttaggtgtgcgctgggtccctggtgctcttcactgttgcctgtcacttttttttccttttttgtaatattgatgacatcaatgtaacatttgagatatttctgaattactgttgtaatggctaaaatcacataaacgtttgtgtcggaatggtgtcctctctttctcttcctttttctctttattaacgatttaaatgtaactttctgaacacattgcattgaattcttcctttaacaaaaagcaaaggcgtaggtaaaagctcaaatgaatttattctttcggtatggtaaaattgaaccaatcacagttaagatgagagatcaacctgagttttaaaatacctttaataaatattagttgaaaaaatgtn

SEQ ID NO: 309062 - DNA, 1616 bp, Homo sapiens
  misc_feature (1532)..(1532): n is a, c, g, or t
  misc_feature (1534)..(1534): n is a, c, g, or t
  misc_feature (1536)..(1537): n is a, c, g, or t
  misc_feature (1540)..(1540): n is a, c, g, or t
  misc_feature (1614)..(1614): n is a, c, g, or t
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgacatacaagatatattacntntnntanaaatacacaactattagaatataatagaatagaaaaacaccaaataaaaataaacaatattaaaataataaaanta

SEQ ID NO: 309063 - DNA, 1559 bp, Homo sapiens
  misc_feature (1444)..(1444): n is a, c, g, or t
  misc_feature (1455)..(1455): n is a, c, g, or t
  misc_feature (1474)..(1474): n is a, c, g, or t
  misc_feature (1479)..(1479): n is a, c, g, or t
  misc_feature (1509)..(1509): n is a, c, g, or t
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgagaacacaaaacaaacaancaaccaaaganacaacataaaaaccacaancaaanacaacatacatagaaaacaaaaaaacacanaaaaccacaaaaaaaaaaacacacagaagaaaaaagaaaaaaacaccaca

SEQ ID NO: 309064 - DNA, 1597 bp, Homo sapiens
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgagaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaa

SEQ ID NO: 309065 - DNA, 1891 bp, Homo sapiens
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaaatgacggggaggaagcttttgaggatgaggaagaggagatcgatggatagtcggaatagagccgccccaactcagatcctacaacacgcaattccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcggggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcatctctctaaaa

SEQ ID NO: 309066 - DNA, 1504 bp, Homo sapiens
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaa

SEQ ID NO: 309067 - DNA, 1596 bp, Homo sapiens
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaa

SEQ ID NO: 309068 - DNA, 1563 bp, Homo sapiens
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgagaggaggtggcctagagccttcagtcactggggaaagcagggaagcagtgtgaactctttattcactcccagcctgtcctgtggcctgtcccactgtgtgcacttgctgttttccctgtccacatccatgctgtacagacaccaccattaaagcattttcatagtgaaaaa

SEQ ID NO: 309069 - DNA, 1762 bp, Homo sapiens
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggtaaaagaagagtattcaaaagagaagaatctgccagtctaagaccagtcctaccttctcctccatagtcaaaatgacagattttgaaattccttatgttttagtgtctaatgttcactttccctctggcaggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaa

SEQ ID NO: 309070 - DNA, 2331 bp, Homo sapiens
gggggcggcagcggaggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggtatgtagtcatgatcactgggaactggccaaatgacacaccttcttcctaacagccctgcaaagcacagttcttagtgttcagtgccaaggtgacactgtgtccacggcagccctgagtcctggcctagctccatgcagtccatgggtggtcatggctcacagatcaacgccagcctgcagagggctgctgcagccctcccattgcagagcagcctcagactggaaggaagaaagagcaaggaaaagcttcaagccaggcttcataggctataggcaacttgaaaggacttcaaagagccaggggccaaaagcacaggttatgaccagagctagacagatgctgaggccaccttctctgctggtcacactgccttcaccttgcctgtttaattgtagttgagtataaagagaatgcctcttaaaaatgtatgtatttcagaaccaattaagttttctaaccctatcctcttcctcaatcaatagcctcagatgagctaaacttacttcttactttattatgatccccagtgtttttgaggtcactgacatagaaaaatatttcttcaggtaaaagaagagtattcaaaagagaagaatctgccagtctaagaccagtcctaccttctcctccatagtcaaaatgacagattttgaaattccttatgttttagtgtctaatgttcactttccctctggcaggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctcggtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaa

SEQ ID NO: 309071 - DNA, 1268 bp, Homo sapiens
  misc_feature (109)..(109): n is a, c, g, or t
aatagactccctcctaaagggccttccatgtaagcagaacgaaccttggcacacaattcagtgtggatatttgggaaacagttccaagtggaatatataatatcagtcnggaaaagatttcattaggatagctttttgtgtatgtatatgtatatttatttttaggaatagatctatagttgtacatgaattcctgttaggaatactctgaatgagcttaacccacttgccaaatatccttgtcccttccatcattttatttttgagatggggtcttgcagtgttgcccaggctggactcaaactctggggcttaatcatccttctgagtagctgggactacataaaggccaaagtataattgcttttgatttttaaaatcttcttgcccatcatttttataaaaataaagctgtttgtccaacacggtgaaacctcatctctactaaaaatacaaaaaattagctgggcatggtggcacacgcctgtaatcccagctacttgggagactgaggcaggagaattgcttgaacctgggagatgggggttgcagtgagcctagatcacgccactgcactccagtgtgggcggcagagtgagactctgtctcacccaaaaaaaaaaaaaaaaagctattgacactgttaatattttggatgacttaaatttagcagctctagaatgcaaagggtatattaaggagcattacaatagtgaaccttcatcgtcagcttttattcaattaagagctccagaaatgcagaaattatgggttaacttctaagaataccatcaaatccctgtgaattctggttgccaacagtaataaccagtaatgggcacctttaccggacagctcctttaccataaccagtagtgggcagttctgcggtcagcacttaactacaagggcggtctctgtttcttcaccagagagagaagattttcctgtgtaatttgtgccatttccctgaagttggttcttgagcggaaagatgtgcttggtaaccagacagcagctttacataggttatagattttgctcattgatgctgttaagaattatttccactcatacctgttcagggctccagacagccaatagccttcatcccacagtttgggcttcagctattaacacataaagataaccagttgcagctaccgtgcctggctgacaattttttattattttattttattttattttattttattttatttgagacagactccagcctgggcaacaagagcaaaactctgtctcaa

SEQ ID NO: 309072 - DNA, 1308 bp, Homo sapiens
  misc_feature (149)..(149): n is a, c, g, or t
gtatccacactgaattgtgtgccaaggttcgttctgcttacatggaaggccctttagagggagtctattgtcatcagaacgaaccttggcacacaattcagtgtggatatttgggaaacagttccaagtggaatatataatatcagtcnggaaaagatttcattaggatagctttttgtgtatgtatatgtatatttatttttaggaatagatctatagttgtacatgaattcctgttaggaatactctgaatgagcttaacccacttgccaaatatccttgtcccttccatcattttatttttgagatggggtcttgcagtgttgcccaggctggactcaaactctggggcttaatcatccttctgagtagctgggactacataaaggccaaagtataattgcttttgatttttaaaatcttcttgcccatcatttttataaaaataaagctgtttgtccaacacggtgaaacctcatctctactaaaaatacaaaaaattagctgggcatggtggcacacgcctgtaatcccagctacttgggagactgaggcaggagaattgcttgaacctgggagatgggggttgcagtgagcctagatcacgccactgcactccagtgtgggcggcagagtgagactctgtctcacccaaaaaaaaaaaaaaaaagctattgacactgttaatattttggatgacttaaatttagcagctctagaatgcaaagggtatattaaggagcattacaatagtgaaccttcatcgtcagcttttattcaattaagagctccagaaatgcagaaattatgggttaacttctaagaataccatcaaatccctgtgaattctggttgccaacagtaataaccagtaatgggcacctttaccggacagctcctttaccataaccagtagtgggcagttctgcggtcagcacttaactacaagggcggtctctgtttcttcaccagagagagaagattttcctgtgtaatttgtgccatttccctgaagttggttcttgagcggaaagatgtgcttggtaaccagacagcagctttacataggttatagattttgctcattgatgctgttaagaattatttccactcatacctgttcagggctccagacagccaatagccttcatcccacagtttgggcttcagctattaacacataaagataaccagttgcagctaccgtgcctggctgacaattttttattattttattttattttattttattttattttatttgagacagactccagcctgggcaacaagagcaaaactctgtctcaa

SEQ ID NO: 309073 - DNA, 591 bp, Homo sapiens
agctcctttaccataaccagtagtgggcagttctgcggtcagcacttaactacaagggcggtctctgtttcttcaccagagagagaagattttcctgtgtaatttgtgccatttccctgaagttggttcttgagcggaaagatgtgcttggtaaccagacagcagctttacataggttatagattttgctcattgatgctgttaagaattatttccactcatacctgttcagggctccagacagccaatagccttcatcccacagtttgggcttcagctattaacacataaagataaccagttgcagctaggctcggtggctcacacctgtaatcccagcactttgggaggccaaggcgggtggatcacctgagggcaggagtttgagacaggcctggccaacatggtgaaactccatctctactaaaaatacaaaaattagccgggtgtggtggcccatgcctgtaattccagctactcgggaggctgaggcaggagaatcacttaaacctgggaggcggaggttgtggtgagcagagatcacgccattgcactccagcctgggcaacaagagcaaaactctgtctcaaa

SEQ ID NO: 309074 - DNA, 1120 bp, Homo sapiens
gtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccaattacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataaaaattttgcaagctaactatt

SEQ ID NO: 309075 - DNA, 1013 bp, Homo sapiens
cgaagtatttgtggtggctgagagtggcttgtttaaaaaaaatgcagagtgcagggctgagagggagtggtagttcatgctggggcaaaagccagatgttcagtgtgatcttctgggctttgcttgctgagcttgtcatggggacactatgtgggcagcacggaggttggggtaccagatgtgcttcctgtcctcagtaaagaacttggagtatgttgttcctcaaatatcttttgatgaatgggtgctccaggagtttctactgacaggctacattttatccatatgcagaggggcagcccttctcttttgttcttgaagtattctttcgctgtgacagtgtctcatccagcagctgcaatgccacagctagggggttgtctttcagctggtgggatgaattacgcacaggcatctaccttgctgttctttggccctgtagcttgcatttgtgagttcacagggaaaggtgcgagatgctacccgtgactgtggcattcactctgggaagaactgcttggactggctctaactaacaccttatgcacactttcagggagtagaggccttacatttgctttgatattaacagcccagtttttctgtcattgtgataaagcaggaatgtgtgattatttttcttttatttctatttttaaaaaatgcttattatgtcctccacttaggtacatgtctgttgtgaacagctcattcctgtaaaatgctgctcatcattgctgcaagtcagtgcaacaaactgtgcatatgaattactgttgaaagaggtattggtttagcagcacaaatgattgggttatatttctctcaaactaagggacgtttgggagaggtggggagataattttcccatctgtttcctgaactctgttagatatccaggggcagagctgtttgttactctagctgaatctttatgtagaaaaaggatggcctgattattcattcagtcagagagatatttgttctttcgattaatatttgtggaatatata

SEQ ID NO: 309076 - DNA, 781 bp, Homo sapiens
gtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacggtacatgtctgttgtgaacagctcattcctgtaaaatgctgctcatcattgctgcaagtcagtgcaacaaactgtgcatatgaattactgttgaaagaggtattggtttagcagcacaaatgattgggttatatttctctcaaactaagggacgtttgggagaggtggggagataattttcccatctgtttcctgaactctgttagatatccaggggcagagctgtttgttactctagctgaatctttatgtagaaaaaggatggcctgattattcattcagtcagagagatatttgttctttcgattaatatttgtggaatatata

SEQ ID NO: 309077 - DNA, 404 bp, Homo sapiens
agggacttaactgtaaagtggcgtagggagaggactgttgagtggaaatggagccagtgattgagaaactgagcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacggtaaactcagaggaggaggaagacctggaccttagcgcctttggttctgagctcttgagggtgtggagtgtgtattatattaaagagggtgtcagcacccttattagtgagata

SEQ ID NO: 309078 - DNA, 1210 bp, Homo sapiens
gtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccaattacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgccc

SEQ ID NO: 309079 - DNA, 1298 bp, Homo sapiens
gtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatatgttacataaatagtaaatggatgtacggtccgccctccctgtgcttgggttttgcatcctatgaatactgtattttcaatccacgtttatttgaaaaaaatctgcttgtgagtggacccgcatggttcaaaacccgtgttgttcaaggaccaactgcgtatgtgtttttctcatatgaggtggaaagtgagaaatggtacctgtctacagacttcccttcaacatccatcaagacagagccaattacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataaaaattttgcaagctaactatt

SEQ ID NO: 309080 - DNA, 902 bp, Homo sapiens
agtgacctgaaaactcaaagcgtaaatgcttcagagccgagagtgtggtctgtggagtcacagcgttacctgggagctgatgaaaaatgcagaatctcgggcctgcttagacctgtgagtcagaagcgacggcttaggagccccagcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccaattacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgccc

SEQ ID NO: 309081 - DNA, 866 bp, Homo sapiens
atattttgtaataaaatgcctttatagtactataaaaacatagaaaagaatattgatatagttttgggcttgagcatttggctttcaactttagagttctgagtgtttttctttttctttttttttcttttttctttttttttttttttgagatagggtctcactctgttacctaggctggagtgcaatggtatgatcacagctcgctgcagcctcaaattcctgggttcaagtgattctcctgcctcagcctcccaagtagctgggactgcaggtgcacgccatcacaactggctaatttttgtatttttttggggagacggtgtctcactatgttacccagggtggtctcaaggaagttctgaaggtcctgtcagctgtaatgccaagtttggcaatgagaaaaaggttaagaactaaaatgactccctgtcagggaagttgcctacactcagctattctccaggataggcagggctgtcccgagaggaagacacaggtgacaaatagctctcctgcatgtgtcttcaaggctgtgattggtttttaaaaattgtgtttgaaattcttcctccaggttgattcctcgtgccgttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataaaaattttgcaagctaactatt

SEQ ID NO: 309082 - DNA, 451 bp, Homo sapiens
gaagctgcaattacaggcgtgcaccaccacacccagctaattttggtatttttagtagagacgaggttttgccacattggtcaggctggtcttgaactctcagccttaggcaatccgcctgcttcggcctcctgaagtcctgggattacaggcataagccaccacgcctggccaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgccc

SEQ ID NO: 309083 - DNA, 561 bp, Homo sapiens
gagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagttagtggggcataagaagtgtatttatgtacctgctttgtaaaggttttatgtggatttgaaaagttattgtgtttatatagtagttatgtatgttattactgatttgtagcatttttcatctcttattaagcgttttatattattttttctgtgtcttatttttaatccttcttttttttgttgacgtgttgttt

SEQ ID NO: 309084 - DNA, 516 bp, Homo sapiens
gagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagttagtggggctttattatctatatcttctagtttattcatttctcttgttttattttatatgtgtttactcttagctttcctttattattcttctatctcttcttccacttcctctttttcgatcttcttatagtttctcctttgactctt

SEQ ID NO: 309085 - DNA, 3011 bp, Homo sapiens
gagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagttagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagcggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgccagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaagtttgagacctgcccgccctcctcgcagctctgctctgtgtcctcaggaagtcacagagtctactgaggcaaggagagggtgattctttccccaaatcccttcttccctggttcccaaaccaaagacagcctgcagccctttctgcatggggtgctctgttgacaggcttcccagatccctgagtctctctttccttcctcctcgatctttagttgtccacggtcaattcagtgcttccattgggggacagtcccctccgggatgacctgattcacctccagcccagggaatggaatctagaggaatacgtggggtgggtctggacaaggagcggcaggaatcaccacccatctccagctgtggagccctgtggaggggaaggggaagcttggggttcagagggaactcttccaggagaggggtgcccagtggaggtaaagatgatagagggttgtggggggtctctagttgaatgttttggcccatgactttggaacatggctggcagcttccagcagaagtcacgctccccatcccccaggggacatgggacctttttcctgcttcctggtcactttcaaagaactatttgcgcaatctgtgggtctgtggattcacggggctttctgtgtgggtgctgcagttgcttttgtctgcagcagcaggacacatctttcctcttactcagccctttatggcccatggggaactccgtggctcagggagagctgaactccaggggtgtgacctgggacaggtgggcctgaggtgcccagctcagggcagccaggtggctcatgggctgtagtgagccagctccctgggggaaaaggctgtgggccgttaggaccatcctccaggacaggtgacctctatgaggtcacctacggctgtggccgtgcaggcctccttccagcccagagtggcccagtagagcaaggcagacagtgacctccacccccgcagccctcttaaaaggccagtactcttgggggtggggggagggtttagaaagcatttgcccatctgcctttctttcccccagcccccacccgctttgaatgtagagacccgtgggcacttttccttttgtggtggggggtgcggaggaggtacccccacccctggcacagccgcctggaatgcaggactgtcactgctgttcgggtgatgacctcgttgccaagctcctcctgtccccttgttctgggggcaggcgctgtgcttctgtgaggtggtttagcttttgctttcgaagtggccagctgcggccaccaggtctcagcacaagagcgcttcctttgcacagaatgagcttcgagctttgttcagactaaatgaatgtatctgggaggggtcgggggcacgagttgattccaagcacatgcctttgctgagtgtgtgtgtgctgggagagtcagagtggatgtagagcgcggttttatttttgtactgacattggtaagagactgtatagcatctatttatttagatgatttatctggtaaatgaggcaaaaaaattattaaaaatacattaaagatgatttaaaaaaaaaaaaa

SEQ ID NO: 309086 - DNA, 3375 bp, Homo sapiens
gagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagttagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagcggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgccagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaagtttgagacctgcccgccctcctcgcagctctgctctgtgtcctcaggaagtcacagagtctactgaggcaaggagagggtgattctttccccaaatcccttcttccctggttcccaaaccaaagacagcctgcagccctttctgcatggggtgctctgttgacaggcttcccagatccctgagtctctctttccttcctcctcgatctttagttgtccacggtcaattcagtgcttccattgggggacagtcccctccgggatgacctgattcacctccagcccagggaatggaatctagaggaatacgtggggtgggtctggacaaggagcggcaggaatcaccacccatctccagctgtggagccctgtggaggggaaggggaagcttggggttcagagggaactcttccaggagaggggtgcccagtggaggtaaagatgatagagggttgtggggggtctctagttgaatgttttggcccatgactttggaacatggctggcagcttccagcagaagtcacgctccccatcccccaggggacatgggacctttttcctgcttcctggtcactttcaaagaactatttgcgcaatctgtgggtctgtggattcacggggctttctgtgtgggtgctgcagttgcttttgtctgcagcagcaggacacatctttcctcttactcagccctttatggcccatggggaactccgtggctcagggagagctgaactccaggggtgtgacctgggacaggtgggcctgaggtgcccagctcagggcagccaggtggctcatgggctgtagtgagccagctccctgggggaaaaggctgtgggccgttaggaccatcctccaggacaggtgacctctatgaggtcacctacggctgtggccgtgcaggcctccttccagcccagagtggcccagtagagcaaggcagacagtgacctccacccccgcagccctcttaaaaggccagtactcttgggggtggggggagggtttagaaagcatttgcccatctgcctttctttcccccagcccccacccgctttgaatgtagagacccgtgggcacttttccttttgtggtggggggtgcggaggaggtacccccacccctggcacagccgcctggaatgcaggactgtcactgctgttcgggtgatgacctcgttgccaagctcctcctgtccccttgttctgggggcaggcgctgtgcttctgtgaggtggtttagcttttgctttcgaagtggccagctgcggccaccaggtctcagcacaagagcgcttcctttgcacagaatgagcttcgagctttgttcagactaaatgaatgtatctgggaggggtcgggggcacgagttgattccaagcacatgcctttgctgagtgtgtgtgtgctgggagagtcagagtggatgtagagcgcggttttatttttgtactgacattggtaagagactgtatagcatctatttatttagatgatttatctggtaaatgaggcaaaaaaattattaaaaatacattaaagatgatttaaaaaaaaaaaaaaaaaaaaaaaaaaaaaaaaaaaaaaaagaaaagaaacaaacaaaaagaaaacaaaacaaagagacaacaaaacagacacgaccaagcaaagacgaagaaagacagaaggacccaagcgacgacgaagcaagaaacaacaagacaaaatgaaagaagacaatcagaaagaaacgaatacccaaaacaacaagagaaaagagacagaacaaaaggaacaacacatgaaacaaaaagaaacaaaagaaagaacaaacacaagaaaagagtaatgaataggaacactgacaagaagaaagaaagaacacgaagagagaaaagaccacagaaaagcaaataacaaaaaaagctgataataagaaacaaa

SEQ ID NO: 309087 - DNA, 2837 bp, Homo sapiens
gagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagttagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagcggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcagcccttgactcctaagccccttcctccttccattctgcatcccctccccatccaacctaaatgccacagctggggctgagctgtattcctgtggagggacctctgccgtgcctctctgaggtcaggctgtgctgtgtgatgggcaggctttgccccagcccacccctggcaaggtgcacttgttttctggtttgtacaaggtgtcctgggggcccgtggcttccctgccagtgaggagtgacttctccctctcttccagtcctgtaggggagacaaaaccagattggggggcccaaggggagcatggaaaaggccggctcccctgtctttccttggctgtcagagtcagggtaacacacaccaagagtggagtgcggccagcaagtttgagacctgcccgccctcctcgcagctctgctctgtgtcctcaggaagtcacagagtctactgaggcaaggagagggtgattctttccccaaatcccttcttccctggttcccaaaccaaagacagcctgcagccctttctgcatggggtgctctgttgacaggcttcccagatccctgagtctctctttccttcctcctcgatctttagttgtccacggtcaattcagtgcttccattgggggacagtcccctccgggatgacctgattcacctccagcccagggaatggaatctagaggaatacgtggggtgggtctggacaaggagcggcaggaatcaccacccatctccagctgtggagccctgtggaggggaaggggaagcttggggttcagagggaactcttccaggagaggggtgcccagtggaggtaaagatgatagagggttgtggggggtctctagttgaatgttttggcccatgactttggaacatggctggcagcttccagcagaagtcacgctccccatcccccaggggacatgggacctttttcctgcttcctggtcactttcaaagaactatttgcgcaatctgtgggtctgtggattcacggggctttctgtgtgggtgctgcagttgcttttgtctgcagcagcaggacacatctttcctcttactcagccctttatggcccatggggaactccgtggctcagggagagctgaactccaggggtgtgacctgggacaggtgggcctgaggtgcccagctcagggcagccaggtggctcatgggctgtagtgagccagctccctgggggaaaaggctgtgggccgttaggaccatcctccaggacaggtgacctctatgaggtcacctacggctgtggccgtgcaggcctccttccagcccagagtggcccagtagagcaaggcagacagtgacctccacccccgcagccctcttaaaaggccagtactcttgggggtggggggagggtttagaaagcatttgcccatctgcctttctttcccccagcccccacccgctttgaatgtagagacccgtgggcacttttccttttgtggtggggggtgcggaggaggtacccccacccctggcacagccgcctggaatgcaggactgtcactgctgttcgggtgatgacctcgttgccaagctcctcctgtccccttgttctgggggcaggcgctgtgcttctgtgaggtggtttagcttttgctttcgaagtggccagctgcggccaccaggtctcagcacaagagcgcttcctttgcacagaatgagcttcgagctttgttcagactaaatgaatgtatctgggagggggggggtcctggctgggggggggtaccgagct

SEQ ID NO: 309088 - DNA, 1390 bp, Homo sapiens
gagcagcaaaaggggagaagatcccactactctcccaccacctgccctttctctgagggacgtttaccacgaggcctcaggctggggatggagagagttgctctgggagttggggtaccacccccagggcaggatggggacaggatcacctgcccgggacaccaccattatcattctcctctagtgacgcagcagctggttctgggagttaaaggagcattggaaggcccaaaccctctcccttgagtggccaccccagcctggttggctggttttccccttttctcttgtttcaattgggtctttaccttgaactctcctctctggctttgcggtgggctgtggaggctggttttgaccaaaagttagtggggcgggaggaaggggcaggaggaagggttgaggttacttggggcgagtcccttccccttcagagaggcttctatccttcccagggaggaggcgccgctgagacccttctgctgagagctctgccctcccctcatcacctggcctgtgcagaaacgctcatgcacacctggctgcacaggtgtgcacgcattacccttcgcgtgtacgttcccatgtgccccgtgaaagcatgtgtggctgcagacgtgtccacatgggccttgcgaacctgggttagaaaccctggccaggcgaacgtggggtgattcacagcacaaaagacctcaccaccacacctgcactcaccccaccttgcatgcaccttgctacctgcttgcggctttcagcggagggcaggggtctggcacaggtgcgatggcaccccatgctccaggcatacagatgtggtttctcggctgcaccgggccaggctgcgggtgtgcaggcgtctgctaagttgtgtgatgtatcagcacaggctttgagacgtctggaccctgtccttcctcccgtgaggggttcttgttctttctgactcaggtgacttttcagcccttccaattcccctctttttctgccctcccctccaactcagccaacccaggtgtgggcagtcagggagggagggagtgtcccaccacgttctcagggcaggaggaagggttgaggttacttggggcgagtcccttccccttcagagaggcttctatcgcttcctttgcacagaatgagcttcgagctttgttcagactaaatgaatgtatctgggaggggtcgggggcacgagttgattccaagcacatgcctttgctgagtgtgtgtgtgctgggagagtcagagtggatgtagagcgcggttttatttttgtactgacattggtaagagactgtatagcatctatttatttagatgatttatctggtaaatgaggcaaaaaaattattaaaaatacattaaagatgatttaaaaaaaaaaaaa

SEQ ID NO: 309089 - DNA, 640 bp, Homo sapiens
cagactacaattgtgagtcctgaactgtagctgcctcaaagcgccttcatgatactattctgaagtgactactctgaaatgtggacagtgaagtttggtgaatttggtcatttagtttcttcaaagataatgagattgtgtttcccctaaggatgtatttacagctagtcagtggaaactgaatccattcccagttttaatgcttttccagttcaaacgtgatatgcatgtatgtgtctctttctaacccttcgagcttctctctgtgtacgatttagggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaataatgactccgttcaaaaactaagtctcatatatatttggttcgattgagggctttttcagccaggtgaccactttcatctgtgatcttctcccaatcagtctgtccgaccacaaaacctatggcccttttcctatctgcatccttcgtcgac

SEQ ID NO: 309090 - DNA, 719 bp, Homo sapiens
tgctctagaggatcccagcaacattggactcgagagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcatcgagtccaatgttgctgggatcctctagatacctcgcgacac

SEQ ID NO: 309091 - DNA, 2094 bp, Homo sapiens
  misc_feature (4)..(4): n is a, c, g, or t
  misc_feature (17)..(17): n is a, c, g, or t
cagnatgaatctggagngggtgagtacagacaggaagactaggtagagattagtgctttgctttcaggtgaaaaaaaaatgaggtcagtgaattattaaataaaaaggaatggcagaggagaaagagaggacaggattgagctgaactgttcaggagctggaatggttaggacttggattgtccagagagttttctctttgtgacttaaaatatatggcttttcccagttttcctgggttagtttttaattttttaaacttgcggtttcaaatgagtcattctaccccttagactgtccagagagggagggggctctttgcatatttatttttcctaaagctcagcctaatgctatgttctttttaggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctatacagcatgggcccttttctcttgttttcttaattttatttttaattgctttttaaatatggtatgtcctaattaaatgctagctgaacatcccaaaacctttttttcattgaatattatatggctcaatgattccgtagcacatgttgtaaaacacagggttcaaatgatgttcaaaacactcatctttgttttatagctgatttctctatctttgtgtcttgaagactgaccaagttcaaatattcatcagttccctggagcatatccattctgtaacatgatgctttatttaaaaattttttttgatcctctctctgttcttccctctcttctttccttccttcttcttttcactttctgcctttatgctgttaggtttttattttttcctgatctggctttgaattctggtagacagaactgatgtattctgtggaactcaagcttgttgccttcatttgaacttgaattgtggatttttaaatgaagattgcagggaaagagtataaagatgcagagcactctggcatgtaacctttaagcctgtcaggttttcaagttcttgccagattgttcattactggaaagcatggccttctgcacagaatttcctctcttgtggttaataccaggtggaacccagaaacatacagagataaaacccaaatattatttctatgtaaacacagaaaagggactcttccctttttcatcctgcaaagaaaaaagtcatcttttagcatgaaagaagatgagagagccttcttcctcaagcataatttgcattttgtaatccaactcagtaatttgtaaatgtgttcactgaagacttcaatattttgaaatattctctttcaggcccacagatgaaaatcctttacttttatgacctacattaaagactgtatgaatagagcctaatagttactagcatttgaatagtatcactttgggttcaacaaattgatattatagtactgaatacccctaatttaatggaaattctaacaactttctgtacttttatcttccctgaaaatctgaatttttaagcaagtgactttaagttcattaagtcaatattgaatgtataaattgctacattaaataacttctgctgtttgtaaaaaaa

SEQ ID NO: 309092 - DNA, 5011 bp, Homo sapiens
gctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcatcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctataca

SEQ ID NO: 309093 - DNA, 4429 bp, Homo sapiens
tgctctagaggatcccagcaacattggactcgagagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcatcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctataca

SEQ ID NO: 309094 - DNA, 6142 bp, Homo sapiens
gctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcatcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctatacagcatgggcccttttctcttgttttcttaattttatttttaattgctttttaaatatggtatgtcctaattaaatgctagctgaacatcccaaaacctttttttcattgaatattatatggctcaatgattccgtagcacatgttgtaaaacacagggttcaaatgatgttcaaaacactcatctttgttttatagctgatttctctatctttgtgtcttgaagactgaccaagttcaaatattcatcagttccctggagcatatccattctgtaacatgatgctttatttaaaaattttttttgatcctctctctgttcttccctctcttctttccttccttcttcttttcactttctgcctttatgctgttaggtttttattttttcctgatctggctttgaattctggtagacagaactgatgtattctgtggaactcaagcttgttgccttcatttgaacttgaattgtggatttttaaatgaagattgcagggaaagagtataaagatgcagagcactctggcatgtaacctttaagcctgtcaggttttcaagttcttgccagattgttcattactggaaagcatggccttctgcacagaatttcctctcttgtggttaataccaggtggaacccagaaacatacagagataaaacccaaatattatttctatgtaaacacagaaaagggactcttccctttttcatcctgcaaagaaaaaagtcatcttttagcatgaaagaagatgagagagccttcttcctcaagcataatttgcattttgtaatccaactcagtaatttgtaaatgtgttcactgaagacttcaatattttgaaatattctctttcaggcccacagatgaaaatcctttacttttatgacctacattaaagactgtatgaatagagcctaatagttactagcatttgaatagtatcactttgggttcaacaaattgatattatagtactgaatacccctaatttaatggaaattctaacaactttctgtacttttatcttccctgaaaatctgaatttttaagcaagtgactttaagttcattaagtcaatattgaatgtataaattgctacattaaataacttctgctgtttgtaaaaaaa

SEQ ID NO: 309095 - DNA, 5218 bp, Homo sapiens
  misc_feature (4287)..(4287): n is a, c, g, or t
gctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcatcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactggtaggagacagaccaaccactttgaacagtgtctctttattaaaattcttaaagnaggtttaaattcagatctgtggttagacaactactgttgatatacactttagtggtaaaagtttccataatcatcttcaaggagacttttggatactctttatttttcccccagacccaaaagaaccctctaatgtggtgttaagagaaagttttaacagagtgctaagaaacttacccttgtactcatctatttgtgggtggttttaggggagtataccttttaagaaaatcaattacatatgaaagggcattcttacattccagcagatatgtggcacagcctacccaacatatgcataattgtctcttctttgctacaagatctccaaatttgagtttctgtcaacagaggcagaagaacttattgaatggggaggcagagggttgccactggctgctagatttgttcttctgcattttatcctaagtgacggggaaaaattaaatgactgtgtaggcaatggattttgctcaggctgattagaggcttacatagtgtgagtttaaagtttctgtgtacctaatgtaaaatgctttcgatcacacctctgtagagatgtttgcctttccctgtcattcaagaatatgcgacctatagagttacgttgacttttcagtgtttgctgaagtacagagattagcaatgccttggaatagtgttgctttttaaatccagaatattactcggtttatttaatacttgagcccttgctaaagttgctcctcatattcttttgaaaatgtacaaaatgagaactctgattcctaccccctagagtatacagaatctccagggagtggtcccatcgaacccgtgtgtgatatagaggactcttgataaaaactgtgtttatataaagatggtgtcaacctctacattccaagatttcaaatgtggattaaaaaataagttttaaagttaatggcat

SEQ ID NO: 309096 - DNA, 5763 bp, Homo sapiens
gctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcatcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagtatgccatgtggaagaggtgtgagcctttcttcagcccaagaaggaaactttaaacatatttgcacaataaaatttcaaattaaacatttcaaaaagggtgctcagactagaaatacatgctcttctgaaattccatgttgcaactgtaactcctgtcatatatacccagtgtatgaggaaaagttcttgcagttttcacactgcccttctgtattgctgcctggctgtgctctgttgttggaactgaaatatgaaatttttactttgaagtatgttaatgtcaaagttgatcgtattaagtttggaaatcctttgaggtttatctaataagtgtgttggagcttctgtctcttctggtaatactgtaccctgttgaaccaagaacagttttattgtttgtgggacttcgttggttttctaataccataacctgtgtccctgtgcagtcagggggtcacttctttaagatcatgtataatacggcccgtcatatacacgtagatagagccatgtgattccagaaattagaagactggatctgtggaatccatacatgttaaaattttgccaaaatgagatgattaaaatttttgtgagttttataaactgttgcagttcgccttactgatttttcaatgataatcacttttatgggaagggggcttaggaacaaaaaactttgccaagaatgcaaaatcttactggtttttaaagcttgtaacagttgtgtgtaaaacttttatatttgaaacgtaaactcaccctttctgccactgctttcattgcacttttcataccaagttctctccaacgtggtgtctgaaagatttttattatatacactctttatggaattcaatgaagtgtggttatgctgtgtttctgaagtttttaggcttttcttcattggcctgcctaatactagtgtgtttctataacttcagatgattcaaaagtttagtgcttcattgtagcaaaaaatgtatataactcataatatcctacatgtagtattcaaaatcaattattaataaccaataaaagactcaacacattttcattgcgtgttcttctttaagacacctaaactcatatctcataatttctgaatccgcaatccctattcattaattgattacagtttttgagttgttggaaagcctagccctctcagattcagggttcagaaagaattaccaggtctggtaaaattgtctgactagcccttagcctcagaatggtcaacttcatagtataagcaaagaaagtggtgatctcatatagtcagctttttcatgaacattaattcatggtgaatgcactcacagcaaccaaaatccaaaaaaaaaaaatgttcatctaaaaccttaaacattagcttggctcattgagttcttggtacaacctgcttttcatatgacacagtatcaaacatgatttcagatgaaatgggtggtgttaatattgtgttaaagaaa

SEQ ID NO: 309097 - DNA, 1301 bp, Homo sapiens
gctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcatcgagtccaatgttgctgggatcctctagatacctcgcgacac

SEQ ID NO: 309098 - DNA, 2908 bp, Homo sapiens
gctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcatcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaggagttcctcaagccgtcggattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaaaaaaaaaaa

SEQ ID NO: 309099 - DNA, 3069 bp, Homo sapiens
gctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagacacacgggataaaggtctagtaaacagaggtcgcggccaggcaatcatcgaggcccaggattggtcaagcaagaagactttcgggataagatgatgggtagaagagaagatagtcgagagaagatgaacagaggagaaggtagccgggacagagggttggtgaggcctggaagcagtcgggagaaagtgccaggtggtcttcaagggagccaggacaggggtgcagctggcagccgagaaaggggaccacctcggagggctggcagtcaggagaggggacctcttcgaagggctgggagtagagagagaataccaccccgaagagctgggagcagggagagaggaccacctcgagggcctggcagtcgagaaaggggactgggaagatcagattttggtcgtgatagaggtccattcagaccagaaccaggagatggtggggaaaaaatgtatccatatcaccgggatgagcctcctagggctccatggaaccatggagaagagcgagggcatgaagagtttccattagatggtagaaatgctccaatggaacgagaaagactcgatgactgggatagagagagatactggagagaatgtgaacgtgactatcaagatgatacactagagctctataacagagaggacaggttctcagcaccaccatctcggtctcatgatggagataggcgaggcccttggtgggatgattgggagagagaccaggatatggatgaggactacaatagggaaatggaaagggacatggacagggatgtggatcggatttcaagacctatggatatgtatgatagaagtttggataatgagtgggacagagattatgggagaccactggatgaacaagaatcacagtttcgtgaacgggatattccatctcttccacctttaccgcccctcccacctcttccacctttggatagatatcgggatgatagatggagagaagaaagaaatcgagagcatgggtatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcgggaacagaaagaacagcttcaaaagatgaaagacttcgggtctgagccacagatggctgaccatctaccacctcaggaatcaagattgcagaatacatcttcaagacctggaatgtatccggtatgggagaatgtgtgctcagaaaatgaaatggtttctactttgtatgtttctatgttgtttgattttttttagaagttgaataaataacaaatttcctctataaaatgtaaattttggaaacttaaaagtttatggtaattgaactttgaacaccttaaaagcatgttcaaaagtgtggtagagatgctccttttccccagattttgataagtacaccaagtacacctgaactacatagcttctgttcacaaaatggtagaatttttctaataatttttatgttaaaatagtcctgttggctgggcatagtggctcacacctgtaattctagcactttgggaggctaaggcaagaggattgcttgagcccaggagtttgacaccagccttcgcaaaatggtgagacccctatctctaccaaaaaa

SEQ ID NO: 309100 - DNA, 2894 bp, Homo sapiens
gctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctataca

SEQ ID NO: 309101 - DNA, 2750 bp, Homo sapiens
ccatgttggccaggctggtctctaactcctgacctcaagtgatccactcgcctccgcgtcccaaagtgctgggattacaggcgtgagccaccgtgcctggcctcaatttattttttaaagcctgtgttactctgatgccaaaagcagacaaagacaaaaaaggaaaactacaaaatgtttataaatgtggaaaaagcatttgacaaaattcaacacccatttataatttttaaaaaatcttagaaagctaggaatagaggggaacagaaagaacagcttcaaaagatgaaagacttcgggtctgagccacagatggctgaccatctaccacctcaggaatcaagattgcagaatacatcttcaagacctggaatgtatccgcctccagggtcgtatagacctccccctcctatgggcaaaccaccaggttcaattgtaagaccctctgctccaccagcaagatcatctgttcctgtgaccaggccacctgtcccaataccaccacctccacctcctccacctctacctcctcctcctccagtgataaagccacaaacttcagctgtagaacaggaacgatgggatgaagattctttctatgggctctgggatacaaatgatgaacaaggactgaattcagaatttaagtcagaaactgcagcaattccatctgctccagtattaccacccccacctgttcactcttccattccccctcctggcccagtgcctatgggtatgccaccaatgtccaagccaccaccagtacaacagactgttgattatggccatggccgagatatatccactaataaagttgaacagataccttatggagaaagaataactctacgcccagatccactacctgaaagatcaacttttgagacagagcatgcaggccaacgtgatcgttatgatagagaaagagatcgtgagccttattttgatcgtcaaagtaatgtcatagcagatcatcgagattttaaaagggatcgtgagacacatagagatcgagaccgggatcgtggtgttattgactatgaccgggatcgatttgacagagaacgccgaccccgagatgatagagctcagtcatatcgagacaaaaaagaccattcctcatccagaagagggggttttgataggccatcctatgaccggaagtctgaccgaccagtctatgaaggaccatccatgtttggaggagaacgaaggacttatcctgaggagcgaatgcctctgccagctccttcactgagccaccagcctcctccagctccacgagtcgagaagaagcctgaatcaaagaatgtggacgatattttgaaaccaccgggccgggagagcagacctgagagaattgttgttataatgagaggattacctggcagtggaaagacacatgttgcaaaacttattcgagataaggaggtagaatttggaggacctgcacccagagttctaagcctggatgattacttcatcactgaagtggaaaaagaagaaaaagatccagattctggaaagaaagtgaaaaagaaggtaatggaatatgaatatgaagctgagatggaggagacttaccgcaccagcatgttcaaaactttcaaaaagactctggatgatggcttttttcccttcatcatcctggatgccatcaatgacagagttaggcattttgaccagttttggagtgcagcaaaaaccaagggatttgaggtatatttggctgaaatgagtgcagataaccagacttgtggcaagagaaatattcatggaagaaagcttaaagaaataaataagatggctgatcactgggaaactgcacctcgtcacatgatgcgtctagatattcgttctttgctgcaagatgctgctattgaagaggtagagatggaagattttgatgcaaatatcgaagaacagaaagaagaaaagaaagatgcagaggaagaggaaagcgaactgggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctataca

SEQ ID NO: 309102 - DNA, 819 bp, Homo sapiens
tgctctagaggatcccagcaacattggactcgagagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttccttcaaaaacaggggggatggagggaggaacagcagtagcaacatcatcattaacagcagataatgattttaaacctgtgggtattggtctaccccattcagaaaacaaccaagataaaggcctgcctcggccagataatagagataatagattagaaggcaatagaggcaacagctcatcttacagaggtcctgggcaaagcagaatggaagaccacctggcactttctcccgactgcttccaggcctcaccaaccctctgtcccggctaccttctcctctgttcatcttctctcgactatcttctcttctacccatcatcttatcccgaaagtcttcttgcttgaccaatcctgggcctcgactgattgcctggccgcgacctctgtttactagacctttat

SEQ ID NO: 309103 - DNA, 1057 bp, Homo sapiens
cagactacaattgtgagtcctgaactgtagctgcctcaaagcgccttcatgatactattctgaagtgactactctgaaatgtggacagtgaagtttggtgaatttggtcatttagtttcttcaaagataatgagattgtgtttcccctaaggatgtatttacagctagtcagtggaaactgaatccattcccagttttaatgcttttccagttcaaacgtgatatgcatgtatgtgtctctttctaacccttcgagcttctctctgtgtacgatttagggttacattccgaaaagcaaatgggagatggacacatctgaggcaaagctagacaagttggatggcttgaggactggtactaaaaggaaacgtgactgggaggccattgccagcagaatggaggattatcttcagctccccgatgattatgatactcgtgcttctgagcctgggaagaagagggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctataca

SEQ ID NO: 309104 - DNA, 903 bp, Homo sapiens
  misc_feature (4)..(4): n is a, c, g, or t
  misc_feature (17)..(17): n is a, c, g, or t
cagnatgaatctggagngggtgagtacagacaggaagactaggtagagattagtgctttgctttcaggtgacaggattgagctgaactgttcaggagctggaatggttaggacttggattgtccagagagttttctctttgtgacttaaaatatatggcttttcccagttttcctgggttagtttttaattttttaaacttgcggtttcaaatgagtcattctaccccttagactgtccagagagggagggggctctttgcatatttatttttcctaaagctcagcctaatgctatgttctttttaggtcagatgggcagacctggaagagaagaaggatgcagataggaaaagggccataggttttgtggtcggacagactgattgggagaagatcacagatgaaagtggtcacctggctgaaaaagccctcaatcgaaccaaatatatatgagacttagtttttgaacggagtcattattcctctaaggtggttcgctttgaggtggtctgaagccaaggcctcgcggagcttctttgtgtgtcaccttgcttccacgtttcagttcttgttttgtttctactgctttagttttttttaaagttctccagtgtccccaagaggtattagaatcttgctgtacccaagcaagacgttaatttttcttttaactgttttggggagggagggagtgatagcttaactgctgaagccaggcgggggtctgctggaggattccaacagagagtatttcctccactgtacaatgtcacagactatctctatcatcattgctttgtggctgtttctgttttttactgtatgtaactggtagctgattgtactaggattaaaaacaataaactttcatgataaagccgatgagattcatgggctataca

SEQ ID NO: 309105 - DNA, 1163 bp, Homo sapiens
gctacacctcctccaggaatacctccccctggagttccacaagggatacctcctcagttaacagcagccccagttccaccagcctccagttcacagagctcgcaagttccagagaaacctagaccagcactgcttcctactcctgtgtcttttggttctgccccaccgacaacttaccatcctccgttgcaatcagctggtccatcagaacaagtgaattcaaaagctcctttgagcaagtctgctctgccatacagttcattctcatctgatcaaggacttggggagtcttcagctgctccatctcagccaatcactgcagtgaaggacatgccagtgagatcaggtggcctgcttccagatcctcctagaagtagttacttggaaagtccaagaggcccaagatttgatggtcctcgaagatttgaggatttagggtcaaggtgtgaaggaccgagacccaaagggcctcgttttgaaggaaatcgccccgatgggccaagacccagatatgaaggtcacccagcagagggcactaaaagcaagtggggaatgattccccgggggccagcatctcaattttatattacccccagtacatccctaagtcctcgacagagtggaccacagtggaaaggccccaaaccagcttttggacagcagcatcagcagcaacctaagtcacaagcagaacctctttcaggaaacaaagaaccattagcagacaccagtagtaaccagcagaagaattttaaaatgcaatcagctgcattttccattgctgcagatgtaaaggatgtcaaggcggctcagtcaaatgagaatctaagcgactctcaacaagagccacctaaaagtgaagtctcggaagggcccgtagagccctctaattgggaccagaatgttcaaagtatggagactcaaatcgacaaagcccaagctgttactcagcctgtaccccttgcgaataagcctgtacctgctcaatctacttttcccaggaccgctgtaagatgagctgttgcctctattgccttctaatctattatctctattatctggccgaggcaggcctttatcttggttgttttctgaatggggtagaccaatacccacaggtttaaaatcattatctgctgttaatgatgatgttgctactgctg

SEQ ID NO: 309106 - DNA, 346 bp, Homo sapiens
tatgatcgagatttccgtgataggggtgagttgaggattcgagagtatccagaaagaggagatacatggcgggaaaagcgagattatgttcctgacagaatggactgggaaagagaacggttgtcagacagatggtacccatctgatgtggatagacattcccccatggcggaacatatgccctcctcacatcattcctcagaaatgatggggtccgatgcaagcttagactctgaccaaggccttggaggggtaatggttctcagtcagaggcagcatgaaatcattttgaaagctgcacaagaactgaaaatgcttcggtaagttgactccttcagatcctttc

SEQ ID NO: 309107 - DNA, 928 bp, Homo sapiens
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309108 - DNA, 1296 bp, Homo sapiens
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtgtgcctaccgcatgttgccgctgctgtttctgctgggacgtctgactccagttccttctcccctctccagtgacaaggtcatttacaacttacatttacaatttatagtgtttaccagtattaaattctcagccactcaaaaaaaaaaaaaaaaaaaaccggaaaatagttcttccccctcgggcgattcgcgcgcggggtttcgcaaaaggtgtgtcccttttttacacatgaagcgtggtctcaggtcccagggaggtgatactaaggcctacccccagggcgagggccggcgtcgggacgcatacaggggggggaacccccggagtgagagtgcagtcattggaacggaagccccctcaagtttgtgagacccttgcgaactcacgatttggtgcaatctgaaactgttgcaaacacaatcatgaaccacaacacggtgttgagctcggagaacaacggaagggagcatggaacacattatatgagcacgaaacgaccaatga

SEQ ID NO: 309109 - DNA, 369 bp, Homo sapiens
acccagaaacagcttcagaagcctggctgcagatggagtgccctctgctggacattggagaacacgtcccccaggctgccctgccttgtcctcagttcacccacattgattctcccctacactggctgacactcacaggacactaggactggggccacaaccgggcagaggaaagtcctggggcagtaaaatgtggattgtacctcaaaagagatcatcataagccaggcacagtggtgggcacctgtggttccagctactcctgaagctgaatggggaggatcgcttgagcccaggagtttgagaccagcttgggcaacatagtgagaccctcatctctataaataaataaataaataaataataaaa

SEQ ID NO: 309110 - DNA, 2835 bp, Homo sapiens
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309111 - DNA, 2815 bp, Homo sapiens
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309112 - DNA, 3023 bp, Homo sapiens
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactcaagtagctaggattacaggcatgtgccacctcgcctggataattttgtatttttagtagagacagggtttttccatgttggtcaggctcttctcgaactcccaacctcaggtgatccgcccacttcggcctctcaaagtgttgggattacaggcgtgagccaccgtgcccagccgatattttatttct

SEQ ID NO: 309113 - DNA, 3203 bp, Homo sapiens
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactcaaaaaaaaaaaaaaaaaaaaccggaaaatagttcttccccctcgggcgattcgcgcgcggggtttcgcaaaaggtgtgtcccttttttacacatgaagcgtggtctcaggtcccagggaggtgatactaaggcctacccccagggcgagggccggcgtcgggacgcatacaggggggggaacccccggagtgagagtgcagtcattggaacggaagccccctcaagtttgtgagacccttgcgaactcacgatttggtgcaatctgaaactgttgcaaacacaatcatgaaccacaacacggtgttgagctcggagaacaacggaagggagcatggaacacattatatgagcacgaaacgaccaatga

SEQ ID NO: 309114 - DNA, 3357 bp, Homo sapiens
agcggggggttcttccggtcccgccccctggcgtggctagagaacccctctcggccttccagcccgcgttcccgcttctcccttctcggccgccaccttctcccttctttacctccccacctcgcctagtgtctgtgcgccgccagatagccggaagctcgggtctcagagcagtggcttcgaccaccctagcccagcccagtccatcggtccggcacacagcaggcgcccagccgtggttgataaatgatgagccaatgaaatgagagtggcttaagttcattcattcgctccctagacatttattgggctcctttggtgtgccaggtcccgtatcaggaagcagaacctctgagcctcagcgtctggccagataaataaatggcacatggtagcgggtcagcgaaaagcccagtgctggaccgtgggacaaaatgggaacagagcagctagcactgtggagatgagaaggggctgagattagaccgagggaaggaggtagggaaatgctgggcatcatcaggaaactcctagcgtgcatcaacaggccctacaggcgagtttagggtcaggtgtcctggggacatgggtgttggtccagtgcagggtttccgaaggtctggatggtggtggccctgaaaaccctgttgagagagtactgagggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309115 - DNA, 2819 bp, Homo sapiens
acttacacttttttggaatggtgcctagcacatagtgagcgcggcattagccatttttctcctagagcgagcccttctctccttgtataatgactctcctgtctctgccggcttccttcctgtagggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309116 - DNA, 2880 bp, Homo sapiens
acccagaaacagcttcagaagcctggctgcagatggagtgccctctgctggacattggagaacacgtcccccaggctgccctgccttgtcctcagttcacccacattgattctcccctacactggctgacactcacaggacactaggactggggccacaaccgggcagaggaaagtcctggggcagggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309117 - DNA, 3250 bp, Homo sapiens
agcggggggttcttccggtcccgccccctggcgtggctagagaacccctctcggccttccagcccgcgttcccgcttctcccttctcggccgccaccttctcccttctttacctccccacctcgcctagtgtctgtgcgccgccagatagccggaagctcgggtctcagagcagtggcttcgaccaccctagcccagcccagtccatcggtccggcacacagcaggcgcccagccgtggttgataaatgatgagccaatgaaatgagagtggcttaagttcattcattcgctccctagacatttattgggctcctttggtgtgccaggtcccgtatcaggaagcagaacctctgagcctcagcgtctggccagataaataaatggcacatggtagcgggtcagcgaaaagcccagtgctggaccgtgggacaaaatgggaacagagcagctagcactgtggagatgagaaggggctgagattagaccgagggaaggaggtagggaaatgctgggcatcatcaggaaactcctagcgtgcatcaacaggccctacagggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309118 - DNA, 2662 bp, Homo sapiens
  misc_feature (29)..(29): n is a, c, g, or t
  misc_feature (32)..(32): n is a, c, g, or t
gctgcttgtgatctagaggacccgtcagnttncagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309119 - DNA, 2513 bp, Homo sapiens
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttgccgccgttcctaggaacggcggcaagaggtccaagtaaaccgctagcttgttggaccgtggaggccacaagagcagaaacatggaatgccagacgctgggggggatcctcta

SEQ ID NO: 309120 - DNA, 1139 bp, Homo sapiens
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtgtgcctaccgcatgttgccgctgctgtttctgctgggacgtctgactccagttccttctcccctctccagtgacaaggtcatttacaacttacatttacaatttatagtgtttaccagtattaaattctcagccactcctaaaaaaaaaaaaaaatcggggttttaatcgggcggggcgaagggtcatgaatgcgctggtctacgtgttctggaccgatttgtccaggggcactgccggcccttagggcgtaatcgtaaggcgattttcgatggagggactctgtgttggaagaacagtgaaagaaacaagtgggaaaaagaagaaaattatgaaaaacatagaacatg

SEQ ID NO: 309121 - DNA, 2448 bp, Homo sapiens
gcattttagcagcggggtggcctggggagcagctgcatgggtggcacggtggggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgggtcccaacgtggaaggattaattaattctttctaaagcagttgcagccgggcttggtggctcacgcctgtaatcccagcactttgggaggcccaggcgggcagatcacttaaggtcgggagctcgagaccagcctggccaacatggtgaaaccctgtctctactaaaaatgcaaaaattagccaggtgtggtggcacacgcgtgtaatcccagctacttgggaggctgaggtggaagaatcacttgaaccctggaggcggaggctgcagtgagccgagatcacgccattgcactccagcctgggcaacgttgtgaccttgtctcaaaaaaaaactaaaaaataaagcagttgcatcttgactcgtacaaaagtagcccccaccagagtagaccctgcgggtgccagctagaactccacaaggggccatgtcttcacactccttccagatggatgagttgatggaaaccctgtcccttccttgtcccagcttgtcagtcctgggcaggagagaatttcaggttgtgccttggttagaggagctgtgttgggtcctaaacactaggaccacaaaggggagtgaactgtgttcccagggcttgctgacgcccgtggactatggagtcaggatgacaggacagtgcggtgaggggcatctgcgacaggactgcgggctctacccgccctgatgtgggagctcctggagtgggggtgagcagtgagccagggtctgcagggctgtcctctctccacagccaacagccaggccttacagtggggcaggcttagtgactgtgcctcagttatgctgtacctgggagtgggcaggccctctcccatgtcaccatcaaaacccactgatgaaggctggtgggagtctgagggctgcacccgggtatggtgagttcccctcagggattgtgctgagcgccttggcctggcttcttggctccgcccacctgctctccctgccaccaagttgtcttccccgggtggcatgtgccacttggctgcctcgtgcctgggcacagtggtgcctattatgggccctccaggtggctctggtgctcagcctgctgtgagcaggaacagctgagtcccaggggttcttgcacacagcagggctcgggtttgaatccaggctctgctgcttggtcgctgcatgagcttctgctgtgctgacctctctggtttgtctcgtcatgtgtaaggtgacaccagatacctacctcttagggctgccccgagactaaaataagaccatgtgcatgaaccacttaccaaagtgcctgttgctctccaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309122 - DNA, 1530 bp, Homo sapiens
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctaggtaatgactgcacagctcaaggttgggaagccaggacctctctggcctggggccagctgcctttgcctggggtcagctgcctttgcctggggtttgaattcccgaaggagcaggcagctgagagcaggcctcccccaggaagagccttcagagccacgtgggggcatcttcccaaatgtgcaccccacctggcactcatcagatttgtgcgcttgtgatttgtttgtccttgataccacgcacaagggcaggtttttggggtggtggaaatggccagggcccatgggtctgtctccagcagttagccctgtggctgcaataaagtacagttctccctgtgttaagatcctaaccagggttaaggatcagtgtgtccgttgctagaatccagagcccacctgctgctctgaaaagcaggctcctgaggccagtgggggagcagtgccccccatgcccttcaccgaggagcctctgtgcctgtcccttgtcctcggccccaggagtctcctcaactgacactgaagtggtggaagcagttgagtgccaggtcatcccccatcaccacactggggcagcgtccccaggcttccagcagctcccaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309123 - DNA, 830 bp, Homo sapiens
  misc_feature (791)..(793): n is a, c, g, or t
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgccgccgtctcacaggcaaagcacggcacagcggggagtgagaccgagaacgaagcggtgccccagtctaggctgcggggacctgtccttgctcagcttggctgtccctgtagcccagcctgcacctagggnnnaccgcatgttaggctgcagaaagctgacgggtctcta

SEQ ID NO: 309124 - DNA, 937 bp, Homo sapiens
aggagtacgctacacccggaagtgtcttcagggagaggaagccggcggcctcactgctatgggccgcaacaagaagaagaagcgagatggtgacgaccggcggccgaggctcgttcttagcttcgacgaggagaagaggcgggagtacctgacaggcttccacaagcggaaggtcgagcgaaagaaggcagccattgaggagattaagcagcggctgaaagaggagcagaggaagcttcgggaggagcgccaccaggaatacttgaagatgctggcagagagagaagaggctctggaggaggcagatgagctggaccggttggtgacagcaaagacggagtcggtgcagtatgaccaccccaaccacacagtcaccgtgaccaccatcagtgacctggacctctcgggggcccggctgctcgggctgaccccacctgagggaggggctggagacaggtctgaggaggaggcgtcatccacggagaaaccaaccaaagccttgcccaggaagtccagagaccccctgctctctcagcggatctcctccctcacagcatcactacatgcacacagccgcaaaaaggtcaagaggaaacatccccgacgggcccaggactccaaaaagcccccaagggcccctcgtaccagcaaggcccagcgcctctgtttgtgtgtgggtggtggtgtgtggtgggtggtgtggtgtgttggtggttgtgtgtgtgtggtgtggtggtggggggggtgagtgttttctttcttagcttggctgtccctgtagcccagcctgcacctaggtgtgcctaccgcatgttgccgctgctgtttctgctgggacgtctgactccagttccttctcccctctccagtgacaaggtcatttacaacttacatttacaatttatagtgtttaccagtattaaattctcagccactc

SEQ ID NO: 309125 - DNA, 1454 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309126 - DNA, 770 bp, Homo sapiens
aacaaaggagtatgaaaaccatggactgaatggaccatgttatgtattcagagagagaagccactcatcaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaaaaaaaaaaaaaaaactcgagactagttctctcttctacaagccacaaggacttgggaacactatacctattatcgggcgcatgagctggggtcctagggcgagtctaagcctccttattcgagccgagttgggcagcaggaat

SEQ ID NO: 309127 - DNA, 1597 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaaaaaaaaaaaaaaaactcgagactagttctctcttctacaagccacaaggacttgggaacactatacctattatcgggcgcatgagctggggtcctagggcgagtctaagcctccttattcgagccgagttgggcagcaggaat

SEQ ID NO: 309128 - DNA, 1379 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcagaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309129 - DNA, 1689 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcggtgagtggcggcggggcgggcgggggcgccggccgcgggcgcctgtaacccctgccagacggaggacttccctcccggcgcccctgtcctgtcggcggcgagggctcccaccggagcagggtgcgcccccgcgtctcctgggtgagccgcgtccccgcgggccgggtgggctgggccacgcagtcgccgctcaccgcgcgggacgcggctctctccctcccaccctcgggcccagagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309130 - DNA, 1367 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309131 - DNA, 1252 bp, Homo sapiens
ctccgagggatagtgtcaaaccagcggctgtaaacgacggcagtactataacgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309132 - DNA, 1531 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggtgcgggccggggccatgggcgagcaagcgggcgggaggccgtgcggggctgggattcagtgccccgctccccgcaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309133 - DNA, 1602 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggtgcaggccaagctggagaacgccgaagtgctggagctgacggtgcggcgggtccagggtgtgctgcggggccgggcgcgcggtgagtggcggcggggcgggcgggggcgccggccgcgggcgcctgtaacccctgccagacggaggacttccctcccggcgcccctgtcctgtcggcggcgagggctcccaccggagcagggtgcgcccccgcgtctcctgggtgagccgcgtccccgcgggccgggtgggctgggccacgcagtcgccgctcaccgcgcgggacgcggctctctccctcccaccctcgggcccagagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309134 - DNA, 1358 bp, Homo sapiens
aatcgaggctgtactggtcccgaagttccttatgattgctgctggcgggcgccgaggtgcaggccaagctggagaacgccgaagtgctggagctgacggtgcggcgggtccagggtgtgctgcggggccgggcgcgcggtgagtggcggcggggcgggcgggggcgccggccgcgggcgcctgtaacccctgccagacggaggacttccctcccggcgcccctgtcctgtcggcggcgagggctcccaccggagcagggtgcgcccccgcgtctcctgggtgagccgcgtccccgcgggccgggtgggctgggccacgcagtcgccgctcaccgcgcgggacgcggctctctccctcccaccctcgggcccagagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309135 - DNA, 1411 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309136 - DNA, 1340 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgcgtctcctgggtgagccgcgtccccgcgggccgggtgggctgggccacgcagtcgccgctcaccgcgcgggacgcggctctctccctcccaccctcgggcccagagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309137 - DNA, 1614 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcggtgagtggcggcggggcgggcgggggcgccggccgcgggcgcctgtaacccctgccagacggaggacttccctcccggcgcccctgtcctgtcggcggcgagggctcccaccggagcagggtgcgcccccgcgtctcctgggtgagccgcgtccccgcgggccgggtgggctgggccacgcagtcgccgctcaccgcgcgggacgcggctctctccctcccaccctcgggcccagagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcagaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309138 - DNA, 1160 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcggtgagtggcggcggggcgggcgggggcgccggccgcgggcgcctgtaacccctgccagacggaggacttccctcccggcgcccctgtcctgtcggcggcgagggctcccaccggagcagggtgcgcccccgcgtctcctgggtgagccgcgtccccgcgggccgggtgggctgggccacgcagtcgccgctcaccgcgcgggacgcggctctctccctcccaccctcgggcccagagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggaaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309139 - DNA, 963 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309140 - DNA, 743 bp, Homo sapiens
gtcggccgccccgggcccgcgcggccaatcggcgcattgagatgcaaataagcggctataaaaggggcgggaccgcggcgggccggaagccgcgaggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgaggaggaagaattttgtagagctgccagcgctctcccaggttcacccacccaggcttcaccagccctgtgcgggctctgggggcagaggtggcagaaatggtgctgggcactagtgttccaggcagccctgggctaaacaaaagcttgaacttgccacttcagcggggagatgagaggcaggtgcactgagctgcactgcccagagctgtgatgctctgtacatcttgtttgtagcacacttgagtttgtgtattccattgacatcaaatgtgacaattttactaaataaagaattttggagttagttacccttgaa

SEQ ID NO: 309141 - DNA, 1299 bp, Homo sapiens
ctgcatcagacgagaggcccattttccaacacgcccaagaaaaaatatacataaaggttgatgtgttttcaaatgggtttttgctttgctcttctcttttctccctaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309142 - DNA, 1541 bp, Homo sapiens
  misc_feature (16)..(16): n is a, c, g, or t
  misc_feature (23)..(23): n is a, c, g, or t
cacttagtgcatagtncgaggcnggtgtgaatcggccgaggcgctgcccaccgctgccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaaga

SEQ ID NO: 309143 - DNA, 820 bp, Homo sapiens
gggcccagaggcccactgccctctcttcccaccctaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaaga

SEQ ID NO: 309144 - DNA, 1040 bp, Homo sapiens
  misc_feature (16)..(16): n is a, c, g, or t
  misc_feature (23)..(23): n is a, c, g, or t
  misc_feature (904)..(904): n is a, c, g, or t
  misc_feature (929)..(929): n is a, c, g, or t
  misc_feature (945)..(945): n is a, c, g, or t
  misc_feature (956)..(956): n is a, c, g, or t
  misc_feature (983)..(985): n is a, c, g, or t
  misc_feature (1002)..(1002): n is a, c, g, or t
cacttagtgcatagtncgaggcnggtgtgaatcggccgaggcgctgcccaccgctgccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatgggtggccgtattgactcgggggaacgtccattggatgagtccggggtttntcgagacccgggccttcttaccggncttggatgggctccanggcggggggcnacacagcggggaatgggcggttggttnnnccctgttttccgtcccncgggggggggtcagggaccggccccagggggggggcgc

SEQ ID NO: 309145 - DNA, 366 bp, Homo sapiens
acaagcttctactctccttgcacatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaaga

SEQ ID NO: 309146 - DNA, 388 bp, Homo sapiens
tcttaacaaacagctgccccagccaccccagctctgcctgaattaattgaacccagtgtgtgttgttattgttaatttacatttttctttgttttgaatctggtttacaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaaga

SEQ ID NO: 309147 - DNA, 968 bp, Homo sapiens
  misc_feature (649)..(649): n is a, c, g, or t
  misc_feature (695)..(695): n is a, c, g, or t
  misc_feature (719)..(720): n is a, c, g, or t
agtcccaggacaaattcacactcagggctgtgccagaaaccggtatacaccagctcgtttctggcacagccctgagtgtgaatttgtccgccactgcatcgccaagtcccaggagcgagtggaagggaaagtgcaggtgtccgtcctcaagggccaggtgtacatcctcggccgggagtcccagctcctcattgtagagagacagccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaangcaacaatcagatacggaagactcttatgctcagcaccaacaggtncgcaaatccggaagaagatgatgnnaatcatgaccgagaggtgcgacaatgacttgaagaagtggtccataatgatccgaccagcttgggaagactagaaaggtggcatctatatcttccggaggttcgtgaaagtaaatgcgggagccagttgatgggaacctggctcggggaggggatcgcacccgggcacaggtctgacgtggttaacccacattgtcccgggacgttgggaaacaaacgctcggcggagaaggggcccgggctagaaag

SEQ ID NO: 309148 - DNA, 2097 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309149 - DNA, 1778 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaaga

SEQ ID NO: 309150 - DNA, 1854 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagaaaacacacaaccgacagacacgacagaaaacaaacacaacaaaaaacaaacaaaaaacaaaacacacacacaaaaa

SEQ ID NO: 309151 - DNA, 2087 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagacgaaaaaaaaaaaaaaaaaaaaaaaaaaaaactttttgggcggcctgggccctaaaaatttttgtaaacaccttcggttgggggcggcgggggccccacgacgagggtcaagcgtcgaacagggggcccaacagcggttcaccaaagaggaacacccgggggcccagaacaagagtgcgggggttccccccccagataaaaaaacgccggggggaacccgaaacggttcgtgaaaaatctccgaagggagtgcgggggacccaagcgggatctatacacgggggcccaaggaaatcgaatataaatggc

SEQ ID NO: 309152 - DNA, 1887 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagaaaaaaaaaacacacaccaccaaacaaaaacccgccctttttggcgggggaaacaactaacagcgcggatttccaccttttgaaaggagaagggcccgggggaataaccg

SEQ ID NO: 309153 - DNA, 1852 bp, Homo sapiens
  misc_feature (1784)..(1784): n is a, c, g, or t
  misc_feature (1788)..(1788): n is a, c, g, or t
  misc_feature (1791)..(1791): n is a, c, g, or t
  misc_feature (1797)..(1797): n is a, c, g, or t
  misc_feature (1802)..(1802): n is a, c, g, or t
  misc_feature (1804)..(1804): n is a, c, g, or t
  misc_feature (1806)..(1806): n is a, c, g, or t
  misc_feature (1811)..(1811): n is a, c, g, or t
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagacaacanacanaanaaaaanacaangnanagaanaaaaacaagaaggacagcaaaacaacaagaaagcaagccaa

SEQ ID NO: 309154 - DNA, 1812 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagaaaaacaaacaaaaaacaaaacacacacacaaaaa

SEQ ID NO: 309155 - DNA, 1835 bp, Homo sapiens
  misc_feature (1800)..(1800): n is a, c, g, or t
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagaattatcacaacaattagcgccntgtacttgggggatctgcaaattgaaggaggcccc

SEQ ID NO: 309156 - DNA, 1840 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgagtggttcactgcactgtgaaaacagattccagacgccgggaactcacgcctccaatcccagacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaaga

SEQ ID NO: 309157 - DNA, 1744 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtaacctgccggtggagtacaacctgccggtggagtacaacctgccggtggagtacaacctgccggtggagtacaacctgccggtggagtacaacctgccggtggagtacaacctgccggtggagtacaacctgccggtggagacaca

SEQ ID NO: 309158 - DNA, 1693 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtagacccgacgtgccacccaacgggccccacgaagagcccccccacgagccgcgcaaagagccacgcgaagagccccccaaagagccggagatcct

SEQ ID NO: 309159 - DNA, 2000 bp, Homo sapiens
aagcgcgggtcaccctcggggcttggggacagcaggctcacacagttgcccttggcgcccgcactggatgagttccacggtgcctccctcaggccccaagtccaggtggcagctgtctaactggagcaggaactcggagacggatggggacactctgacctgcacaaagctctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309160 - DNA, 2220 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccggtgggcggcggcactgcgtgctggggaagcacagattcttgtgccctctgtgaccttgagcctgccactgacctctctgagccctgctggctgcctccccaataggaatgacaactcctacttcatgaggttgtagtgggggctcaggggcacagggagatcccgctgaggctcccagggccctgcctggtgcttggcaaggagcagttctgatgggggatgtgtcagctgccagaggctcagagccaaggcccctcccacatctcctgcctgcgtgcattcctcacatcctggccttgggccaaactgctcagcctcagccgccttccctcgatgctggaggatcaggtccaagagatgcctctccccgaccagcctaggactgcagtcagcattcccaggccccagtgtggtctgtggggctgtgtgcagagtgtgcgagacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaaga

SEQ ID NO: 309161 - DNA, 2225 bp, Homo sapiens
agcggaggctcctgactcgtgggcagagagtgtgctgacgcgccgcctggttcgggaaaggctctcgtttcttgccgcgagcaagaagcgttgggtggaccatcgcccagaaggtaagctcgagcacctgtttacttattactagtattagtattattagcactactagtagtagtactactactagtaggagaggtagtatactagtagtgcggagtatggatcacgggaccaaactattgttctgacttgcgcttccagtccgatgtacgacgtggaccctggtgcctggtcactctaggcgtgggacacacgtaacgggctcgaggtctggccgggatcgccagcgcaatgacataccaccggtgagtggttcactgcactgtgaaaacagattccagacgccgggaactcacgcctccaatcccagacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309162 - DNA, 1869 bp, Homo sapiens
cactcgccggggactgggaccgaggcaggagggaaggggctcccgatgctcaaacgcctggcaccggattccagacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309163 - DNA, 2044 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309164 - DNA, 1882 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgttgggcgataacatcactgatttatcgcccaacaccgaaatttttaatgcaggtttggtagtttaggacctgtgggtttgttaggtactgtttgcattaataaattaaagctccatagggtcttctcgtcttgctgtgttatgcccgcctcttcacgggcaggtcaatttcactggttaaaagtaagagacagctgaaccctcgtggagccattcatacaggtccctaattaaggaacaagtgattatgctacctttgcacggttagggtaccgcggccgttaaacatgtgtcactgggcaggcggtgcctctaatactggtgatgctagaggtgatgtttttggtaaacaggcggggtaagatttgccgagttccttttactttttttaacctttccttatgagcatgcccgtgttggggataaatacgggatcctt

SEQ ID NO: 309165 - DNA, 2196 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgtgagtgtctgcagccctgtccggcctcttgggaaccgccgtctcgggcgagcacgagcctggaccgttgcagctaatggttgtggctgaggctcaggggggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309166 - DNA, 1919 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309167 - DNA, 1536 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccgttctggcacagccctgagtgtgaaggctcgatgtcttcatgtacctgaacgaagtcgcgggcaagcatgggtggccgtattgactcgggggaacctgtttcgatcggaactgaaggtccctgaggtatctacgagaacgcgagaaggcacatcctttacccatgctcatgtagacatcgaggccttcaccatggaccggggaacgtgcgcaaaaatcagacaaggcttgggttcgaaattgcgtgagctggtgtatacc

SEQ ID NO: 309168 - DNA, 1578 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgtcatttttatagctccccaccgcagctgccccccacccttcccttcgatgacaacgtttgcaggcttcagggggaccagggaacaaatgctggcctggcagcccccactacgctgcca

SEQ ID NO: 309169 - DNA, 1247 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatggtcatcgaagggaagggtggggggcagctgcggtggggagctataaaaatgacaattaaaaga

SEQ ID NO: 309170 - DNA, 1763 bp, Homo sapiens
tcctcgactcccgccagaacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaagggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309171 - DNA, 2048 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaagctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309172 - DNA, 2127 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctgaccctgtctttcctttcccctccgcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309173 - DNA, 1560 bp, Homo sapiens
ggcgagagcgtgcgtgccgctcctgggaagccctcggaacgccgccttgctcctccaaagtcacactttttcctgcctgacttgttcctctccagctattctacctccagctgtgggggcgtcgaagaaaaagatgagatcaagttgaggggaaaaattgtctgatttctccagccctttgtttcccaggcctctggcaagcgaggctggtgctaggctgagggctggggaccgggggatctgccggaccccaccagctggtggggaaatggacagaggagaggggtgcagatccccgcgggaggtgggctgtagggtgtccagggactggtatgtcatctgcccaccactttctgtcttttttcagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309174 - DNA, 1277 bp, Homo sapiens
  misc_feature (1141)..(1141): n is a, c, g, or t
  misc_feature (1166)..(1166): n is a, c, g, or t
  misc_feature (1182)..(1182): n is a, c, g, or t
  misc_feature (1193)..(1193): n is a, c, g, or t
  misc_feature (1220)..(1222): n is a, c, g, or t
  misc_feature (1239)..(1239): n is a, c, g, or t
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatgggtggccgtattgactcgggggaacgtccattggatgagtccggggtttntcgagacccgggccttcttaccggncttggatgggctccanggcggggggcnacacagcggggaatgggcggttggttnnnccctgttttccgtcccncgggggggggtcagggaccggccccagggggggggcgc

SEQ ID NO: 309175 - DNA, 1453 bp, Homo sapiens
ggcgagagcgtgcgtgccgctcctgggaagccctcggaacgccgccttgctcctccaaagtcacactttttcctgcctgacttgttcctctccagctattctacctccagctgtgggggcgtcgaagaaaaagatgagatcaagttgaggggaaaaattgtctgatttctccagccctttgtttcccaggcctctggcaagcgaggctggtgctaggctgagggctggggaccgggggatctgccggaccccaccagctgaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309176 - DNA, 1234 bp, Homo sapiens
  misc_feature (1094)..(1094): n is a, c, g, or t
  misc_feature (1097)..(1097): n is a, c, g, or t
  misc_feature (1099)..(1099): n is a, c, g, or t
  misc_feature (1102)..(1102): n is a, c, g, or t
  misc_feature (1114)..(1114): n is a, c, g, or t
  misc_feature (1127)..(1128): n is a, c, g, or t
  misc_feature (1130)..(1131): n is a, c, g, or t
  misc_feature (1133)..(1133): n is a, c, g, or t
  misc_feature (1136)..(1136): n is a, c, g, or t
  misc_feature (1156)..(1156): n is a, c, g, or t
  misc_feature (1169)..(1169): n is a, c, g, or t
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcggcaagctgggggncgntngantcggggaaccgntctggatgagccnngnntnganaccagaggcaccttcaggcntgaagggtacagncggggggacaaaaggggggatggggggtcggtgggcgtggtgcgcgtctcagggggggggcaggc

SEQ ID NO: 309177 - DNA, 1139 bp, Homo sapiens
gggcccagaggcccactgccctctcttcccaccctaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309178 - DNA, 1123 bp, Homo sapiens
gggacagaaggtgctcccggcgggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309179 - DNA, 1572 bp, Homo sapiens
cccccttctcaccccaacacaccaccattctgccatggagtgcaggctccgtccagccagccccggtgagggagtctgtgtccttcccctccttcatggggctccctctcaccctcacaacagcatcctctctggggacatgctggagacccccatgggcccctcccaggagaggccagctctgcagcttacaggccaggggaagcccacagctcggccctcccggctctgaccccttgtcctatgtccaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaagctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309180 - DNA, 1039 bp, Homo sapiens
aatggaccagttcttcccacaggggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttctggcacagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309181 - DNA, 1158 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaagcctgtgaggggccacgtcaggtggacaccacagactctgaggctctgtctgagagtcggcacatggtggcgtgatcgggaacgtctggaagccggtttaacccggcctttgctatgggcgggggaaaaagggtggtccggtttccacccaagggccttttctg

SEQ ID NO: 309182 - DNA, 1456 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaagggtatgtgcccacctgttgggactcgaagggggttgacttttggggccctggctcctttcccctccctgcctgggaacctaggccctctttacccccgccctgcattcctggaagctagagttcaggcaggggcttcaaggtaacgcacagcccacctccctggacagtacaacccatggaccatggatgcctctaggcttgggaggaacatgccctcggctacccatcactcgggttcatgggcaccaggtctggaatgagagcgctctagtccctgaacagccactcaactttcctgggcctcagtttcctcagctgtatctgaggatgaaagagtgcctgctgttttcctggggtagaatgaggcctgcaagggagcgtccagccctgggccctgaccccggaaggtgctcagtaaacggtgagtgttggcgagctggcctcatggacccctgggacc

SEQ ID NO: 309183 - DNA, 1047 bp, Homo sapiens
  misc_feature (1)..(1): n is a, c, g, or t
ngtccctgtgaaggtcgaccaacgtcaaggatggcaccacccaccagacctccttggagctcttcatgtaggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggacatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagacactagtcttttatttctagtgagtgtgtgtgtgtgtgtgtgtgtgtgtgtgtgtgtgtgtgtgtgtgtagttaattatggttttcttaggccaacctttgtgttttcggacctaagtgctgccgaaggccgccatttgccagacagcctgttaatctggcagtcgacccctctccagcaaaaactaggaatccagaagtgccgcctgggtccgatcctagccagcatcctgggaatctgtcaccaactgtggtcctgtggcaaatgtcaggaaaccaaataaaattcagggaatgccctttgggggcatcaacgca

SEQ ID NO: 309184 - DNA, 1014 bp, Homo sapiens
cgcctgcgcccccgccggcgcgcccctgggagggtgagccggcgccgggcccaggcccggacctggtgggaggcggggggaggtggggacgaggcctggggaggcgggccccgcccatctgcaggtggctgtgaacgctgagcggctccaggcgggggccgggcccgggggcggggtctgtggcgcgcgtccccgccacgtgtccccggtcaccggccctgcccccgggccctgtgcttataacctgggatgggcacccctgccagtcctgctctgccgcctgccaccgctgcccgagcccgacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaaga

SEQ ID NO: 309185 - DNA, 771 bp, Homo sapiens
agcggaggctcctgactcgtgggcagagagtgtgctgacgcgccgcctggttcgggaaaggctctcgtttcttgccgcgagcaagaagcgttgggtggaccatcgcccagaaggtaagctcgagcacctgtttacttattactagtattagtattattagcactactagtagtagtactactactagtaggagaggtagtatactagtagtgcggagtatggatcacgggaccaaactattgttctgacttgcgcttccagtccgatgtacgacgtggaccctggtgcctggtcactctaggcgtgggacacacgtaacgggctcgaggtctggccgggatcgccagcgcaatgacataccaccggtgagtggttcactgcactgtgaaaacagattccagacgccgggaactcacgcctccaatcccagacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggttcattgaggatgtcagcagggagttggtggagaagctgtggcggggccacagcttctcagccagatccatgaagatctgggtccatttatgtctttactcttgctctctactaattcactctgtaaaccccaagcatgtgcacacacaggctgctcgcgc

SEQ ID NO: 309186 - DNA, 443 bp, Homo sapiens
tttttttttagttttggtaaaataatttattgggtttttcccctattataaaagtaatatatataaaagaaaccttagaaagttaggcaagaacataaaaaccacctgtatcctactttgctgagataactattactcttgtgctatttatctttccttccagacattttttgcatacttacatataaataggaccttgcagtactcatcacttaacaagaagtcacgacagatttgtgcagcctgctgggggagtgggtggggtaatggtacgtggcttcttcaccctcagcccctggatttttcaggtggcttctcttcctgatctcaaagccacactccagctaagaaaagtctggtgaagacagatagataatttcggtacctcacctataggttggggaataatgtttcatgatataagtatgatttgaattgatttt

SEQ ID NO: 309187 - DNA, 1894 bp, Homo sapiens
gcggccagggtagctatcgcggcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacatagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaatacattttagtaaatatatatttttaaatagtcaaaaaaacagaaccacacaaatcgtaacccgaaacaacaaaaaggggggggccccaaaaaaattcccccggggggggccccatttggccgcacccttttttgtgtaaagagggggcccaaaaggggggcgttaa

SEQ ID NO: 309188 - DNA, 1855 bp, Homo sapiens
gcggccagggtagctatcgcggcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacatagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaatacattttagtaaatatatatttttaaatagtcaaaaaaacagaaccacacaaatcgtaacccgaaacaacaaaaaggggggggccccaaaaaaattcccccggggggggccccatttggccgcacccttttttgtgtaaagagggggcccaaaaggggggcgttaa

SEQ ID NO: 309189 - DNA, 2204 bp, Homo sapiens
tttttttttagttttggtaaaataatttattgggtttttcccctattataaaagtaatatatataaaagaaaccttagaaagttaggcaagaacataaaaaccacctgtatcctactttgctgagataactattactcttgtgctatttatctttccttccagacattttttgcatacttacatataaataggaccttgcagtactcatcacttaacaagaagtcacgacagatttgtgcagcctgctgggggagtgggtggggtaatggtacgtggcttcttcaccctcagcccctggatttttcaggtggcttctcttcctgatctcaaagccacactccagctaagaaaagtctggtgaagacagtgaagaagttcggaactcagcaagggtggggaagaaggtgcaggatagaggtggatggagtggattccatgaacaggtggaggtgctggaagggaaacagtgctggcctggccaggtctccttaaaaataaatctcgagttttttctgggggcgggggtgggaggggcagaaagaaatcactcctgggttaagcatacaagttataaatcaatcgggtcacgtaactcaacagctttctactccctgatatctactcccagcttcctcattaccagctcattaccaggattaacttgcttctcctttttatctaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacatagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaatacattttagtaaatatatatttttaaatagtcaaaaaaacagaaccacacaaatcgtaacccgaaacaacaaaaaggggggggccccaaaaaaattcccccggggggggccccatttggccgcacccttttttgtgtaaagagggggcccaaaaggggggcgttaa

SEQ ID NO: 309190 - DNA, 1947 bp, Homo sapiens
gcggccagggtagctatcgcggcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctgggcaagaaactaaagcccagagacaggaagagagactcgtgcagggtcacacagcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacatagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaatacattttagtaaatatatatttttaaatagtcaaaaaaacagaaccacacaaatcgtaacccgaaacaacaaaaaggggggggccccaaaaaaattcccccggggggggccccatttggccgcacccttttttgtgtaaagagggggcccaaaaggggggcgttaa

SEQ ID NO: 309191 - DNA, 1636 bp, Homo sapiens
gatatgaggatcaagctaagtgtctgtcaacagctttctactccctgatatctactcccagcttcctcattaccagctcattaccaggattaacttgcttctcctttttatctaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacatagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgatgcagggcatggaacctggacaccctcagctctcctgctttgtgccttatctacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaatacattttagtaaatatatatttttaaatagtcaaaaaaacagaaccacacaaatcgtaacccgaaacaacaaaaaggggggggccccaaaaaaattcccccggggggggccccatttggccgcacccttttttgtgtaaagagggggcccaaaaggggggcgttaa

SEQ ID NO: 309192 - DNA, 968 bp, Homo sapiens
gcggccagggtagctatcgcggcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtcttgggctctgctgtgggctactacctagcttacccacttctcagcacagcttagctggtgaggaacgtgcaggcactgaggctggagggacatggagccccctcttccagacactatacttccaactgccctttcttctgatggctattcctccaccttattcccagcccctggaaactttgagctgaagccagcacttgctccctggagttcggaagccattgcagcaaccttccttctcagccagcctacatagggcccaggcatggtcttgtgtcttaagacagctgctgtgaccaaagggagaatggagataacaggggtggcagggttactgagcccatgacaatgcttctctgtgactcaaaccaggaatttccaaagatttcaagccagggagaagggttcttggtgagtcgtggcacggcgccctagtcacaagctgtatccttccaggtcgattatagacggatcgcctga

SEQ ID NO: 309193 - DNA, 1308 bp, Homo sapiens
gcggccagggtagctatcgcggcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggagcatcgcccattggacttcctgacctcttctgtctttgagggacagagaccaagctagatcctttttctcacctttctgcctttggaacacatgaagatcatctcgtctatggatcatgttgacaaactaagttttttttatttttcccattgaactcctagttggcaattttgcacattcatacaaaaaaatttttaatgaaatgatttcattgattcatgatggatggcagaaactgctgagacctatttccctttcttggggagagaataagtgacagctgattaaaggcagagacacaggactgctttcaggctcctggtttattctctgatagactgagctccttccaccagaaggcactgcctgcaggaagaagatgatctgatggccgtgggtgtctgggaagctcttcgtggcctcaatgccctcctttatcctcatctttcttctatgcagaacaaaaagctgcatctaataatgttcaatacttaatattctctatttattacttactgcttactcgtaatgatctagtggggaaacatgattcattcacttaaaatactgattaagccatggcaggtactgactgaagatgcaatccaaccaaagccattacattttttgagttagatgggactctctggatagttgaacctcttcactttataaaaaaggaaagagagaaaatcactgctgtatactaaatacctcacagattagatgaaaagatggttgtaagctttgggaattaaaaacaaatacattttagtaaatatatatttttaaatagtcaaaaaaacagaaccacacaaatcgtaacccgaaacaacaaaaaggggggggccccaaaaaaattcccccggggggggccccatttggccgcacccttttttgtgtaaagagggggcccaaaaggggggcgttaa

SEQ ID NO: 309194 - DNA, 1038 bp, Homo sapiens
gcggccagggtagctatcgcggcggcggcggcggcggcggttgaactgactcggagcgaggagacccgagcgagcagacgcggccctggcgcccgccctgcgcactcaccatggcgggttcacctgggctggagagaacgacagcttgcaagactcgttcgtctttgaagaagtcatatcattttcttcatcccatgaagaatgtcatagaatttaagatacaggaagctcagcctgggcaacatggctagaccccgtctctacaaaaattagccacaagtggtggcaggcgcctgtaatcccagctactcggaggctgaggcaggatgaggaggattgcttgagcccagaagttccaggctgcagtgagccatgaccttcggcctgggcaacagaacaagacgtcctcaaacaaacaaaacaaaaaaaaaaagatataggaagtgtatgtaggccatttagtgaaatgatcagccgtcctttaaaaagggaaatagatggaaagcacttgcaaaagttccccagccagtcagcctagcaactgggaccttcatctccttcccaacccttgtttacaaataaggaagcttttctcaaagtgtaagtaaccccaaatgaagaaatatagaagaaaacaagttccagggattgctccctccttcaccacagccccaccctgaaaaaagcacaaatcagttaaactttcagaggccaagattcatcccaagtaggaaaacaagattggggccctgccccttgcctatctgaccacaaagccctttaattgaaaactgtagcccagatcgcttctctcaagtcagggtgtgctgacttccatcttttcctctagcaaaaaggcaaaagtagaaagggttgagtgacaggtgagtcttcgtccctctggggcttcggactccgtgggtgtttccagctctgaacaaaccatacagttcatcttcccagctatctcctgcttctctggcttcagaaccatcctagccaactgctctctggccagggcaggtgtctctcaggcgg

SEQ ID NO: 309195 - DNA, 874 bp, Homo sapiens
gcggccagggtagctatcgcggcggcggcggcggcggcggttgaactgactcggagcgaggagacccgagcgagcagacgcggccctggcgcccgccctgcgcactcaccatggcgatgcatttcatcttctcagatacagcggtgcttctgtttgatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtacaggcagtgggtatgggaaaggggcagaagcctcacattcaccctgagagacaggctggcccagacagcattagccccacttcacagagaggacagcgaggcccagggaaggaccaggacttgccaaagtggctacacatagccaagtgaactagagctcatgtctcctgatgcccaggccaaagcactctgtgaacagccagccacttgagaggctcagaaggctttctttagggaacagtgatcttcaggtgcaggcccctatctagcaaatgaggtggccacccaccctcccccaaatctcaccagttccatgggtcactaggctcccatatccaggaggggatctgcagctgtcctgaagcaatgtatcccacttggtgggaggaggatgacaagctctcctctcctcccttcccactcgaatcaggcaaccatttagggtccctgttctgccctctgtccagccccagcctcacctgtgcttaataagcctgc

SEQ ID NO: 309196 - DNA, 336 bp, Homo sapiens
tgtgcccctatgatgcagattcctttctctttcagatgcatttcatcttctcagatacagcggtgcttctgtttgatttctggagtgtccacagtcctgctggtaagaattggggacctcagacttgtagcttggaaagccttgtagtactaggcaagggagaatctgggttctcttgattctctgtgggcatttaagtgaggctgattcctctggcataaacactgagcaggaacttcacagttataattccatttgtaaccactccccttcagatcgcaaagggctccattatcttactgatcctcacaaaggccgagaggcagggaggcagct

SEQ ID NO: 309197 - DNA, 444 bp, Homo sapiens
gatttgtgcagcctgctgggggagtgggtggggtaatggtacgtggcttcttcaccctcagcccctggatttttcaggtggcttctcttcctgatctcaaagccacactccagctaagaaaagtctggtgaagacagtgaagaagttcggaactcagcaagggtggggaagaaggtgcaggatagaggtggatggagtggattccatgaacaggtggaggtgctggaagggaaacagtgctggcctggccaggtctccacaactctgcctcctttgacaggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattca

SEQ ID NO: 309198 - DNA, 1572 bp, Homo sapiens
acctaacggcattccggaacattccacaagatggcgcccttgctttccaatcttcgggctacgggcggaggacgccttgccaggacgtcgacctcgctctgcaaggttcaggggccgacctcagacagaggctcgctctaggggcatgggcgggggccagacgggcctcgagtgggatcctggcacggttggccgatcggcccgggatcccggctgcgggcccgtgtctgccctagcgcgatgggctcgaatgcccggctccacgaatcccggcctttcacccccacggcctctcggcactgccccagctagacaccagcgagctcgtcacagcgcgggcaggcactgcggggcagctgcagacgagccttgtcatacggccggaggaggcctcgcctgcccgtgcggcgggctccgggcaccctgataccttgacacaggaggccccgggcggccgggaagggctgtgcgggggagggactgcgtctacacccgcgcccgactcgctcgggtcacggcactgccctgccaccaggcggctggggcgggggtgaggccaggcgtccgccctcgcgattctgttttctacgctgaggctcggagccttcgaagaacgggacagcggggcccacggacggctctgaaggccttcccgcggccgcaagagctctcggcggccggcgtttgaggcgcgcggctccgctgggaagcgagacccgggtggcgggacaagacttgcttcccggccacgcgcgctcggccggccgtggggcggggcataggccgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaagggaagggtaagtgtcaactcctatttgagaacatttgcttaccccgaattaacatggtattcaaagagtattttatctgggattacct

SEQ ID NO: 309199 - DNA, 3666 bp, Homo sapiens
acctaacggcattccggaacattccacaagatggcgcccttgctttccaatcttcgggctacgggcggaggacgccttgccaggacgtcgacctcgctctgcaaggttcaggggccgacctcagacagaggctcgctctaggggcatgggcgggggccagacgggcctcgagtgggatcctggcacggttggccgatcggcccgggatcccggctgcgggcccgtgtctgccctagcgcgatgggctcgaatgcccggctccacgaatcccggcctttcacccccacggcctctcggcactgccccagctagacaccagcgagctcgtcacagcgcgggcaggcactgcggggcagctgcagacgagccttgtcatacggccggaggaggcctcgcctgcccgtgcggcgggctccgggcaccctgataccttgacacaggaggccccgggcggccgggaagggctgtgcgggggagggactgcgtctacacccgcgcccgactcgctcgggtcacggcactgccctgccaccaggcggctggggcgggggtgaggccaggcgtccgccctcgcgattctgttttctacgctgaggctcggagccttcgaagaacgggacagcggggcccacggacggctctgaaggccttcccgcggccgcaagagctctcggcggccggcgtttgaggcgcgcggctccgctgggaagcgagacccgggtggcgggacaagacttgcttcccggccacgcgcgctcggccggccgtggggcggggcataggccgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaagaaataatggtctcctgtct

SEQ ID NO: 309200 - DNA, 3562 bp, Homo sapiens
acctaacggcattccggaacattccacaagatggcgcccttgctttccaatcttcgggctacgggcggaggacgccttgccaggacgtcgacctcgctctgcaaggttcaggggccgacctcagacagaggctcgctctaggggcatgggcgggggccagacgggcctcgagtgggatcctggcacggttggccgatcggcccgggatcccggctgcgggcccgtgtctgccctagcgcgatgggctcgaatgcccggctccacgaatcccggcctttcacccccacggcctctcggcactgccccagctagacaccagcgagctcgtcacagcgcgggcaggcactgcggggcagctgcagacgagccttgtcatacggccggaggaggcctcgcctgcccgtgcggcgggctccgggcaccctgataccttgacacaggaggccccgggcggccgggaagggctgtgcgggggagggactgcgtctacacccgcgcccgactcgctcgggtcacggcactgccctgccaccaggcggctggggcgggggtgaggccaggcgtccgccctcgcgattctgttttctacgctgaggctcggagccttcgaagaacgggacagcggggcccacggacggctctgaaggccttcccgcggccgcaagagctctcggcggccggcgtttgaggcgcgcggctccgctgggaagcgagacccgggtggcgggacaagacttgcttcccggccacgcgcgctcggccggccgtggggcggggcataggccgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagccc

SEQ ID NO: 309201 - DNA, 655 bp, Homo sapiens
ctctagagcgatcccccttgcgggtctgataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagccc

SEQ ID NO: 309202 - DNA, 1488 bp, Homo sapiens
acctaacggcattccggaacattccacaagatggcgcccttgctttccaatcttcgggctacgggcggaggacgccttgccaggacgtcgacctcgctctgcaaggttcaggggccgacctcagacagaggctcgctctaggggcatgggcgggggccagacgggcctcgagtgggatcctggcacggttggccgatcggcccgggatcccggctgcgggcccgtgtctgccctagcgcgatgggctcgaatgcccggctccacgaatcccggcctttcacccccacggcctctcggcactgccccagctagacaccagcgagctcgtcacagcgcgggcaggcactgcggggcagctgcagacgagccttgtcatacggccggaggaggcctcgcctgcccgtgcggcgggctccgggcaccctgataccttgacacaggaggccccgggcggccgggaagggctgtgcgggggagggactgcgtctacacccgcgcccgactcgctcgggtcacggcactgccctgccaccaggcggctggggcgggggtgaggccaggcgtccgccctcgcgattctgttttctacgctgaggctcggagccttcgaagaacgggacagcggggcccacggacggctctgaaggccttcccgcggccgcaagagctctcggcggccggcgtttgaggcgcgcggctccgctgggaagcgagacccgggtggcgggacaagacttgcttcccggccacgcgcgctcggccggccgtggggcggggcataggccgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaaggtgcgtatgactcttgagtaaagtattttctttgtgtgcaaggatggcccttccctgttaggaaaatgtcttctgcatgtgtaatcactggcttttccgaggtgactggaagctaataag

SEQ ID NO: 309203 - DNA, 2596 bp, Homo sapiens
gcattgtggctccagtagtgacttttacattttaaatctaaatagaagctggaggctttgctggggtactcataggcataaaatatgtaatttattatagagttaaatgctacaaagacagatctaattaataggcctattttcctttttaagttctactcataatttcttcatagtttttatgagtagaacttaaaaaggaaaataggcctattaattagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaagaaataatggtctcctgtct

SEQ ID NO: 309204 - DNA, 4248 bp, Homo sapiens
acctaacggcattccggaacattccacaagatggcgcccttgctttccaatcttcgggctacgggcggaggacgccttgccaggacgtcgacctcgctctgcaaggttcaggggccgacctcagacagaggctcgctctaggggcatgggcgggggccagacgggcctcgagtgggatcctggcacggttggccgatcggcccgggatcccggctgcgggcccgtgtctgccctagcgcgatgggctcgaatgcccggctccacgaatcccggcctttcacccccacggcctctcggcactgccccagctagacaccagcgagctcgtcacagcgcgggcaggcactgcggggcagctgcagacgagccttgtcatacggccggaggaggcctcgcctgcccgtgcggcgggctccgggcaccctgataccttgacacaggaggccccgggcggccgggaagggctgtgcgggggagggactgcgtctacacccgcgcccgactcgctcgggtcacggcactgccctgccaccaggcggctggggcgggggtgaggccaggcgtccgccctcgcgattctgttttctacgctgaggctcggagccttcgaagaacgggacagcggggcccacggacggctctgaaggccttcccgcggccgcaagagctctcggcggccggcgtttgaggcgcgcggctccgctgggaagcgagacccgggtggcgggacaagacttgcttcccggccacgcgcgctcggccggccgtggggcggggcataggccgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggtgtgttgggaaagagtaaagtagatactcacgctttacgttatttccactctttattaattagcacttggactatgattatcatggttcaaatatgtcatatttacttaaagtttttcttcaaaccctttgaaagggaagttaaaactaaaaggaagtcttttagttttacagtgcatgcaagtgagtttactgcgttatcttttatctggcttgtgtccattgctttttgatgagctttcccagcaattgcctcactctcatcttaatctggaattctcacccttaaatgaatttagatgcttgactcattgcataaatcttctctcttctaaggagctccagccacctaccaccacagttgccaggtctggaacacccgcagtagaaaacaagcagcagattggggatgctattcggatgatagtcagagggactcttggcagctgtagcagcagcagtgaatgtaagtggttgtcaatcgtattttaaataatgaaactcgaaatgccagtgctaaatacataataatttaagtcaatttactttgtagcttaatttaacatagaagtagtaagattacaggaattggaaaataatcttgagttctatgtctttcgaattaatggagtgaaacttagcatctaccaaagcctgaggttttattgctaaaatattgtataacttgaaacatttctgtctgacttttcaggccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaagaaataatggtctcctgtct

SEQ ID NO: 309205 - DNA, 1868 bp, Homo sapiens
ctcaatcgagctcggcccaaattcatgaagagagacaacttgtaaattaaacaacacaatggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaagaaataatggtctcctgtct

SEQ ID NO: 309206 - DNA, 965 bp, Homo sapiens
  misc_feature (42)..(42): n is a, c, g, or t
gctgacctagaggatcccgactagtccaaccatacctcatgnatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaagaaataatggtctcctgtct

SEQ ID NO: 309207 - DNA, 1016 bp, Homo sapiens
cttgcttaagtttgagaggattttcttagaataataatagagtgcatgctacaaaatctttgtaggcactaactcactctcctaatctcttccagggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaagaaataatggtctcctgtct

SEQ ID NO: 309208 - DNA, 759 bp, Homo sapiens
ctctagagcgatcccccttgcgggtctgataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaagaaataatggtctcctgtct

SEQ ID NO: 309209 - DNA, 2054 bp, Homo sapiens
acctaacggcattccggaacattccacaagatggcgcccttgctttccaatcttcgggctacgggcggaggacgccttgccaggacgtcgacctcgctctgcaaggttcaggggccgacctcagacagaggctcgctctaggggcatgggcgggggccagacgggcctcgagtgggatcctggcacggttggccgatcggcccgggatcccggctgcgggcccgtgtctgccctagcgcgatgggctcgaatgcccggctccacgaatcccggcctttcacccccacggcctctcggcactgccccagctagacaccagcgagctcgtcacagcgcgggcaggcactgcggggcagctgcagacgagccttgtcatacggccggaggaggcctcgcctgcccgtgcggcgggctccgggcaccctgataccttgacacaggaggccccgggcggccgggaagggctgtgcgggggagggactgcgtctacacccgcgcccgactcgctcgggtcacggcactgccctgccaccaggcggctggggcgggggtgaggccaggcgtccgccctcgcgattctgttttctacgctgaggctcggagccttcgaagaacgggacagcggggcccacggacggctctgaaggccttcccgcggccgcaagagctctcggcggccggcgtttgaggcgcgcggctccgctgggaagcgagacccgggtggcgggacaagacttgcttcccggccacgcgcgctcggccggccgtggggcggggcataggccgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggctacagggaagccaaaagaatgatctagagtatgttgaagaagatggacatgtggtggtacgaaaacaattcccctgtggcctgctggactgggtggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaagaaataatggtctcctgtct

SEQ ID NO: 309210 - DNA, 2505 bp, Homo sapiens
acctaacggcattccggaacattccacaagatggcgcccttgctttccaatcttcgggctacgggcggaggacgccttgccaggacgtcgacctcgctctgcaaggttcaggggccgacctcagacagaggctcgctctaggggcatgggcgggggccagacgggcctcgagtgggatcctggcacggttggccgatcggcccgggatcccggctgcgggcccgtgtctgccctagcgcgatgggctcgaatgcccggctccacgaatcccggcctttcacccccacggcctctcggcactgccccagctagacaccagcgagctcgtcacagcgcgggcaggcactgcggggcagctgcagacgagccttgtcatacggccggaggaggcctcgcctgcccgtgcggcgggctccgggcaccctgataccttgacacaggaggccccgggcggccgggaagggctgtgcgggggagggactgcgtctacacccgcgcccgactcgctcgggtcacggcactgccctgccaccaggcggctggggcgggggtgaggccaggcgtccgccctcgcgattctgttttctacgctgaggctcggagccttcgaagaacgggacagcggggcccacggacggctctgaaggccttcccgcggccgcaagagctctcggcggccggcgtttgaggcgcgcggctccgctgggaagcgagacccgggtggcgggacaagacttgcttcccggccacgcgcgctcggccggccgtggggcggggcataggccgtgacgtggtgtcgcgtatcgagtctccgcccccttcccgcctccccgtatataagacttcgccgagcactctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcaagaaataatggtctcctgtct

SEQ ID NO: 309211 - DNA, 898 bp, Homo sapiens
agcgtgggcgcttccgataacaacactcggagctggggctgtggctatttgttgctgcgccgccaccgcccgagtcatgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaatatttccattcccaaaccacgccgtgggaattttaaaattcttttaaaatttttgtggt

SEQ ID NO: 309212 - DNA, 1542 bp, Homo sapiens
aggaggcgaggccgggtgggggcagctggggaaggactgggcccggctttcggcctcccggctatcgggagccccagtcctagtcggtgaaacgcggagacggcctctaacgtcccgccgtagggggtggagtgggctccgagcggctgggtttcgtttggttggagttgtgccaaaatgtgaggtgcccggtgtgggacgcgcagtccagttggggctctgcccgcctcgggcctgacctacttagtggttccaagttaagagttggcaggagccgcacaaaactgattttattacttttgccactgtggtacttcgtgttagtgtgtccagagtaagttttcagaagagttagcaattgaattgacttagcccgtctgattgcagtgctattgcattaggataaaatggatagaagtttaaataggattaagtctacgaaatgatttcaaagtcttgtcagaataacgttttatggacttaagttcaatgacttaatcttcgtaataatgaaatgaaaaagttcccgttatttagtgaagaatgttgcattgaattagagatttgcggtttatctgtgcccttgggaaaaaatttgcccaccttgtttctttaaattatcgtctcaatgtctcccttttaaaattccacgacttttgaaatatccgtgattacctaaaagcttttgtgcttgtttcctggcctgttttctagaacaggtactaactagggagctctggcagtgaaccttattgacgtggaaagttgtggtcctctttcgtgtcgtgtcttgcttactaccgcgttacaagtgttggtagtgcagtgatctagtggattaccttacgcttttccatcctttcaagacttcctataaggcccacttaagttgggaaagattaaggtgagtgaagcagcgttcttgaagcagttactaaaccagaaaggaggtacacagcaaagattgtttctggcactcgtatttggaagagagctcattagtcttccttacagttgtagaaaggtggacttgggttatttcagactttttttagtttgacattttagaactggttcacgttgcatactggtaactagcagtggtgattaactgcatttttagtggcgaacaagagtgaacttaaaagtcaagggaaatttaagttttttgttgttttttttttcttgagacagagtctgcctctatcgcactccaggctggaatgcagtggcacgatcgatctctgctcactgcatcctccccttcccaggctgaagggatcccgcctcagccagcctcccgaggcgcgtgttaccacgccgggctgatttttatatttgtagtagacatggggtttcgctatgttgcccaggctggtctcgaactccttgagcttgagcgatctgcttgccttgacctcccaaagtgctgggattacaggcgtgagccaccatgcccaattaaagtttttgtaattttcagcttttattttagatcaaggaggtacttgtgcaggtttgctacatgggtatatttcgtga

SEQ ID NO: 309213 - DNA, 2683 bp, Homo sapiens
agcgtgggcgcttccgataacaacactcggagctggggctgtggctatttgttgctgcgccgccaccgcccgagtcatgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacagattttgagtgggaatgttaagcaatcaggtcaagtaaagaagatcgaatatacaaaggaacttctgtttgatgttttgtgtgagtcaccattccttccttacaaatgcagatacaccttcctcacaaatggaagggaagctcatttagaagtttagtttgaagatgcccccaatttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgcagtttaatgtgtgagggcttatgtgtaacgtatgttcaggaaatagaaggataaatggcagagctgaaagtttaggtgggatggggagaaaagacaaatataactaaaatacaa

SEQ ID NO: 309214 - DNA, 2629 bp, Homo sapiens
agcgtgggcgcttccgataacaacactcggagctggggctgtggctatttgttgctgcgccgccaccgcccgagtcatgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaacaggtcaagtaaagaagatcgaatatacaaaggaacttctgtttgatgttttgtgtgagtcaccattccttccttacaaatgcagatacaccttcctcacaaatggaagggaagctcatttagaagtttagtttgaagatgcccccaatttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgcagtttaatgtgtgagggcttatgtgtaacgtatgttcaggaaatagaaggataaatggcagagctgaaagtttaggtgggatggggagaaaagacaaatataactaaaatacaa

SEQ ID NO: 309215 - DNA, 2335 bp, Homo sapiens
  misc_feature (4)..(4): n is a, c, g, or t
  misc_feature (75)..(75): n is a, c, g, or t
  misc_feature (82)..(82): n is a, c, g, or t
  misc_feature (86)..(86): n is a, c, g, or t
  misc_feature (100)..(100): n is a, c, g, or t
cacnccctcttacccggtccgaccccggacgccccacctttctcctcattctagggagtggccgttttaccccanctcggtncagngtttgccaaccgancttcgcgtgcggagcaccttcggcgcgcggagagcgcgaagagaagtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacagattttgagtgggaatgttaagcaatcaggtcaagtaaagaagatcgaatatacaaaggaacttctgtttgatgttttgtgtgagtcaccattccttccttacaaatgcagatacaccttcctcacaaatggaagggaagctcatttagaagtttagtttgaagatgcccccaatttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgcagtttaatgtgtgagggcttatgtgtaacgtatgttcaggaaatagaaggataaatggcagagctgaaagtttaggtgggatggggagaaaagacaaatataactaaaatacaa

SEQ ID NO: 309216 - DNA, 2857 bp, Homo sapiens
aggaggcgaggccgggtgggggcagctggggaaggactgggcccggctttcggcctcccggctatcgggagccccagtcctagtcggtgaaacgcggagacggcctctaacgtcccgccgtagggggtggagtgggctccgagcggctgggtttcgtttggttggagttgtgccaaaatgtgaggtgcccggtgtgggacgcgcagtccagttggggctctgcccgcctcgggcctgacctacttagtggttccaagttaagagttggcaggagccgcacaaaactgattttattacttttgccactgtggtacttcgtgttagtgtgtccagagtaagttttcagaagagttagcaattgaattgacttagcccgtctgattgcagtgctattgcattaggataaaatggatagaagtttaaataggattaagtctacgaaatgatttcaaagtcttgtcagaataacgttttatggacttaagttcaatgacttaatcttcgtaataatgaaatgaaaaagttcccgttatttagtgaagaatgttgcattgaattagagatttgcggtttatctgtgcccttgggaaaaaatttgcccaccttgtttctttaaattatcgtctcaatgtctcccttttaaaattccacgacttttgaaatatccgtgattacctaaaagcttttgtgcttgtttcctggcctgttttctagaacaggtactaactagggagctctggcagtgaaccttattgacgtggaaagttgtggtcctctttcgtgtcgtgtcttgcttactaccgcgttacaagtgttggtagtgcagtgatctagtggattaccttacgcttttccatcctttcaagacttcctataaggcccacttaagttgggaaagattaaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacagattttgagtgggaatgttaagcaatcaggtcaagtaaagaagatcgaatatacaaaggaacttctgtttgatgttttgtgtgagtcaccattccttccttacaaatgcagatacaccttcctcacaaatggaagggaagctcatttagaagtttagtttgaagatgcccccaatttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgcagtttaatgtgtgagggcttatgtgtaacgtatgttcaggaaatagaaggataaatggcagagctgaaagtttaggtgggatggggagaaaagacaaatataactaaaatacaa

SEQ ID NO: 309217 - DNA, 2212 bp, Homo sapiens
atatccatgttgtacccagtgtttagctcccaaattcacttgtaagtgagaacttgcgatatttggttttctgtttctgcattaattcgtctagggtaatggcccccagctacatacgtgttgtcacaaagaacataattttgttcttttctatggctgtgggcaaacttaaacacaacaaaactagatatgtgatatgaggttcataactgatttttatctagaaactatatttacttttgtgttcttgtctttgtaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacagattttgagtgggaatgttaagcaatcaggtcaagtaaagaagatcgaatatacaaaggaacttctgtttgatgttttgtgtgagtcaccattccttccttacaaatgcagatacaccttcctcacaaatggaagggaagctcatttagaagtttagtttgaagatgcccccaatttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgcagtttaatgtgtgagggcttatgtgtaacgtatgttcaggaaatagaaggataaatggcagagctgaaagtttaggtgggatggggagaaaagacaaatataactaaaatacaa

SEQ ID NO: 309218 - DNA, 2562 bp, Homo sapiens
agcgtgggcgcttccgataacaacactcggagctggggctgtggctatttgttgctgcgccgccaccgcccgagtcatgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacagattttgagtgggaatgttaagcaatcaggtcaagtaaagaagatcgaatatacaaaggaacttctgtttgatgttttgtgtgagtcaccattccttccttacaaatgcagatacaccttcctcacaaatggaagggaagctcatttagaagtttagtttgaagatgcccccaatttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgcagtttaatgtgtgagggcttatgtgtaacgtatgttcaggaaatagaaggataaatggcagagctgaaagtttaggtgggatggggagaaaagacaaatataactaaaatacaa

SEQ ID NO: 309219 - DNA, 1808 bp, Homo sapiens
agcgtgggcgcttccgataacaacactcggagctggggctgtggctatttgttgctgcgccgccaccgcccgagtcatgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggccccccc

SEQ ID NO: 309220 - DNA, 2206 bp, Homo sapiens
agcgtgggcgcttccgataacaacactcggagctggggctgtggctatttgttgctgcgccgccaccgcccgagtcatgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacagattttgagtgggaatgttaagcaatcaggtcaagtaaagaagatcgaatatacaaaggaacttctgtttgatgttttgtgtgagtcaccattccttccttacaaatgcagatacaccttcctcacaaatggaagggaagctcatttagaagtttagtttgaagatgcccccaatttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgcagtttaatgtgtgagggcttatgtgtaacgtatgttcaggaaatagaaggataaatggcagagctgaaagtttaggtgggatggggagaaaagacaaatataactaaaatacaa

SEQ ID NO: 309221 - DNA, 1924 bp, Homo sapiens
agcgtgggcgcttccgataacaacactcggagctggggctgtggctatttgttgctgcgccgccaccgcccgagtcatgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgccctatttattgcacaaatgttgtattaatttacatatatattgggcccagaaaaagagaagaaaaaaaattttggggcagcaaaaagttaaacatctttggggggcagagagaggaaggcatgtcagagctgacgaggggtccaacaaaggggagggtgaaagtgggatgtaagacaaaaagg

SEQ ID NO: 309222 - DNA, 2157 bp, Homo sapiens
atatccatgttgtacccagtgtttagctcccaaattcacttgtaagtgagaacttgcgatatttggttttctgtttctgcattaattcgtctagggtaatggcccccagctacatacgtgttgtcacaaagaacataattttgttcttttctatggctgtgggcaaacttaaacacaacaaaactagatatgtgatatgaggttcataactgatttttatctagaaactatatttacttttgtgttcttgtctttgtaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaacatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacagattttgagtgggaatgttaagcaatcaggtcaagtaaagaagatcgaatatacaaaggaacttctgtttgatgttttgtgtgagtcaccattccttccttacaaatgcagatacaccttcctcacaaatggaagggaagctcatttagaagtttagtttgaagatgcccccaatttttagtcaccaattttagcttttgttagtaatgtgttgtaaatattaatactaatgactgactacagtgagttctgacatctctcccaaatcagtttgtgattctagaaagggacacattaacaggttttaacaacacatttttgcacatggttataaaaattcctacacaatgtaatataagtcctaccgcctcaaccacccttctttccttgtccaacatttctcagctcttgtcattttgagcagtatgtctgcagtttaatgtgtgagggcttatgtgtaacgtatgttcaggaaatagaaggataaatggcagagctgaaagtttaggtgggatggggagaaaagacaaatataactaaaatacaa

SEQ ID NO: 309223 - DNA, 1359 bp, Homo sapiens
agcgtgggcgcttccgataacaacactcggagctggggctgtggctatttgttgctgcgccgccaccgcccgagtcatgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaatatttccattcccaaaccacgccgtgggaattttaaaattcttttaaaatttttgtggt

SEQ ID NO: 309224 - DNA, 2643 bp, Homo sapiens
acttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccaccttcctttctgctgcctgatgtctcaatggcttctgaatgactgttctaataaatgatcttaaaacagtc

SEQ ID NO: 309225 - DNA, 350 bp, Homo sapiens
tgcgtgtagtgggtggatctgcaattgtattcctgtttcaagccccgttttcttgcagctcttcggcactgcaaacctaaccgctaatggcgctgtgggtggagaaacgtttgttaggtagcgttatatattgttatctggtgttccctataccgaaaacggcgggtcctggccgccgggaggtactcagaccaggcttcttacatcatggttgcaggatggctgctacagctctggacatcacatcaaaatatggcagaagctaaagcaggaagacagagaaggaggcaaaacagctttattcacttgtggctctcatatgaagaataaagatatttctcgaaaccttc

SEQ ID NO: 309226 - DNA, 456 bp, Homo sapiens
aatgctgttagtttttctcctacctctttcactacttctcctcagtcttcttcccttctagctgacctctaactttagagttcctcatattttggccagtgaggagaatcctgtttattcctgtggctttaaataacatctgtgtatctataattctcaaattgaaatccaagtcctgaccttacccctgtgctccagactcatgtctacccgctgatttgtcatctcattttaatggttcatacacatcttaaatttaacacatccaaacccttgatctcaccgccttccccaaacttctttgggtcttctccgtgtcaatcaatggctgctacagctctggacatcacatcaaaatatggcagaagctaaagcaggaagacagagaaggaggcaaaacagctttattcacttgtggctctcatatgaagaataaagatatttctcgaaaccttc

SEQ ID NO: 309227 - DNA, 2696 bp, Homo sapiens
acttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataactgtggctattactttgttcttggtccttcacagggcctgctccatcccaccttcctttctgctgcctgatgtctcaatggcttctgaatgactgttctaataaatgatcttaaaacagtcaaaaaaaaaaaaaaaaacacttgtggcgccatggccaaaaacttttaacactg

SEQ ID NO: 309228 - DNA, 2572 bp, Homo sapiens
acttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatgtgtgtaactattaatagtaagatgggcaaacctcctagtccttgcatttagaagctgcttttcctaagacttctagtatgtatgaattctttgaaaattatattacttttatttctactgattttattttggatactaaggatgtgccaaatgattcggatactaagatgcatcgtttgaaatcatctagtgtgttgtatgcagttatcctcaaaaacatcagcgatgtctgaacctttaaaacatctgttagagcaaaattaaaagagcatttggtagtaatctaactttttgttcagttaataagtggttgataaagtttccatatttttctggaaaagttaaaaaaagttacatgtcatttggagaaaatacgtaatcagaaatttgtgcatagattgatgccaaaaaagacatttccagcattgtggaacatggtgagacactatataaaattccagaaagaaagcaactggatttacagatttattgtgagacacaaattcactgctgcctttacactaagaaatgtatatgttaaccatatatgctgtatttattttgtcgttaagcatactttcagtttactcagaattttcaatttgctataaagatgtatcaattagcatatagaaaaatattactttaagatgacttgtttcctttgaaaatacctgtgtactgagggttatgatttgtgtcaaaaattgacataagtgcttttacaagcaccaaagttgaatgaattttcaacaaaatgtaattaaagtctatgttttcagttatgactcaggttaagaaatgtgttttaggatctacttgctggtttttctttttgatccaaatgtgtgatctgccctgataaataacaagttatagtaccatctcccccgccaataaaaaagagaagaaaaaagagaaacccgtggcactatgtaaataaagtaagcatactttgttgttagtaaatagatgaggcatgcctgggaaatgctcccttggcataaatagcaatcaattataattagtaaacaggtgtaccaataaaaagaatttacatgataggttaacaaggaccaggaaagtgagtttcctgaaggagttctttgttcctgatcaaagaaattgatacctgttagcattcactgccaccatattttaaggagaaagaactctattggtgtcgtctgagcagccatttaaaaattggaatctaaaggatggttgctgatgtactgtgtggtctggtagaagtggggaaatatgagagatggaggaaaaacttgattatgtcttccatggcatatttactcttactttacttcgtgccaaatcaaatgaaacaagccgtcttacaagtcgttattgcctttaaaaatctgttccgtttttttcccaggtacttaaaatacaagtgccagtaagtggttcttatgtgttttggggggaaaattttatttcccttttcttctgatatttaaaaaattcatcgatctttcaagatgaaccaaggttttttaaaagaaatataggaaacacttcattctttataaaactttctataatgccttatttgaatgttaatcttatgtgctttctaaaaaatgttgtgaaataccaaacttatggattatcactaggttatcaagcatatattagtctttatcagaataaaatgaaatttcataaaaaaaaaaaaaaaaaattgtggggccgcccggcccagggaaaaatttaaa

SEQ ID NO: 309229 - DNA, 236 bp, Homo sapiens
aggcggacaggagtcaccagatggcaaaaaatgttgtgaaataccaaacttatggattatcactaggttatcaagcatatattagtctttatcagaataaaatgaaatttcataactgtggctattactttgttcttggtccttcacagggcctgctccatcccaccttcctttctgctgcctgatgtctcaatggcttctgaatgactgttctaataaatgatcttaaaacagtc

SEQ ID NO: 309230 - DNA, 1107 bp, Homo sapiens
acttccgggaacgccggggaaccgcagtagccgcctgctagtggcgctgctagccggccggcgcaggctgccgagcgggtgagcgcgcaggccaggccaaagccctggtacccgcgcggtgcgggcctcagtctgcggccatgggggcgtccgcgcggctgctgcgagcggtgatcatgggggccccgggctcgggcaagggcaccgtgtcgtcgcgcatcactacacacttcgagctgaagcacctctccagcggggacctgctccgggacaacatgctgcggggcacagaaattggcgtgttagccaaggctttcattgaccaagggaaactcatcccagatgatgtcatgactcggctggcccttcatgagctgaaaaatctcacccagtatagctggctgttggatggttttccaaggacacttccacaggcagaagccctagatagagcttatcagatcgacacagtgattaacctgaatgtgccctttgaggtcattaaacaacgccttactgctcgctggattcatcccgccagtggccgagtctataacattgaattcaaccctcccaaaactgtgggcattgatgacctgactggggagcctctcattcagcgtgaggatgataaaccagagacggttatcaagagactaaaggcttatgaagaccaaacaaagccagtcctggaatattaccagaaaaaaggggtgctggaaacattctccggaacagaaaccaacaagatttggccctatgtatatgctttcctacaaactaaagttccacaaagaagccagaaagcttcagttactccatgaggagaaatacagggcctcactctgttgcccagactagagtgcagtggcataattgggtcactgtaacgttgaactcctgggctcacgcaattcttctacctcagcctcccaagtagctgaaactacaggcttcttacatcatggttgcaggatggctgctacagctctggacatcacatcaaaatatggcagaagctaaagcaggaagacagagaaggaggcaaaacagctttattcacttgtggctctcatatgaagaataaagatatttctcgaaaccttc

SEQ ID NO: 309231 - DNA, 629 bp, Homo sapiens
tccactgaccaccctgagtagcatggttctacaggttaatggggtatattataatccaaatgactgaaatgtggcagacaaagagtgaagtcaaatacatttgagctcttttgattttgtatttatgtgaatggtctgcatttctcaatttcattggaatttatgattgtttcatgtcctatttaatgctttttgtttagctcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaaggtacccaataagactcttaatctccagt

SEQ ID NO: 309232 - DNA, 277 bp, Homo sapiens
  misc_feature (9)..(9): n is a, c, g, or t
  misc_feature (22)..(22): n is a, c, g, or t
  misc_feature (68)..(68): n is a, c, g, or t
tctaagccnttttttagtcacncataggccagacttagggctaggatgatgattaataagagggatgncataactattagtggcaggttaatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309233 - DNA, 4016 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309234 - DNA, 3701 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309235 - DNA, 4076 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagctagaagagaagatatgaaatgtttccagtgcaaagaaatgataagtgttcaagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309236 - DNA, 3755 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggctagaagagaagatatgaaatgtttccagtgcaaagaaatgataagtgttcaagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309237 - DNA, 3818 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309238 - DNA, 3645 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309239 - DNA, 3748 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309240 - DNA, 3110 bp, Homo sapiens
tgactgattcacagggtcaggggaacttgatgaaaagcatgaaccactagcttaaagttgggaaagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309241 - DNA, 3593 bp, Homo sapiens
agcggagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagttgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309242 - DNA, 3762 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309243 - DNA, 3601 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309244 - DNA, 3630 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309245 - DNA, 3963 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgtttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309246 - DNA, 3397 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagaattggaacatcgatcagttaaaaaggctggcattgaggtccaggaaatcaaagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309247 - DNA, 1425 bp, Homo sapiens
ctataccacccatcctgccattatttatacatgcactagtttggaaaaaataaaaactttttttaaaaaaaagaaaaaaatgattaccgggtgggagtgagcatgttttaccctttgtcaacgagcccagctggcatggcttttctggagtgcgaggggccagtgtcctctcccgataccacactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309248 - DNA, 3931 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccagggtgatttctattcactactttccaagctgctaggagaaagggaagatgttgttcatgtgcacaaatataatcctacagaaaaggcagaatcagagtcagacctggtagctgagattgcaaatgtagtccaaaaaaaggatcttggtcgatctgatgccagagagggtgcagaacatgagaggggtaatgctattcttgtcagagacagaattcacaaattccacagactagtatctaccttgaggccaccagagagcagagttttctcattacagcagcccccacctggtgaaggcacctgggaaccagaacacacaggagatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagaaattggaacatcgatcagttaaaaaggctggcattgaggtccaggaaatcaaagaagccgaggcagttgttgaaaccaaaatggagaacaaacccacctcctcagaattgcagaagatgcaagagaaacagaaactgatcaaagagccaggctcgggagtgcctgttgttctcattacaacccttctggttattccggtggttgtcctgctggccattgccatatttattcggtggaaaaaatcaagggcctttggagagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaatattggtgtgtttttgggatgtcttatttttagatggttacactgttagaacactattttcagaatctgaatgtaatttgtgtaataaagtgttttcagagcattagctgtcagtgtattttccagtttttgcgtatttgcagattttacatacaacttttataataattacacaaacccacaaatattagtgaaacttactcgatgtcttcaactaaaagaaatgtgtgtattgtacaaaatttagaagat

SEQ ID NO: 309249 - DNA, 1151 bp, Homo sapiens
tgtcagaggagaaaactgaagctcagagaagtaatttatcaagactgcacagccagtaagagacacgggcaggagtcaaacccagcttgggccctttatgtatgtctcagaaatataccgcctttcttaaaaattagaattgcatacagacaagagccaggccttgctttatcatttaccagttcctattttaagttggaagttgagtgcatgggttgagaaagatgactgggactcattttgaaatgtgccatctttttttagcagattctgaacacaaactcgagacgagttcaggaagagtactgggaagatttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309250 - DNA, 884 bp, Homo sapiens
agcaaggagttacgcggagaacaattgcatgaggggtaaccgagactgcgagatgaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaattgtaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagactttttggtggatgtaaataaccccattctttgcttgaacacagtattttcccaatagcactttcattgccagtgtctttctttggtgcctttcctgttcagcattcttagcctgtggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309251 - DNA, 2624 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttccacagaggtgaccatgtctgggatggaaactcgtttgacagcaagtttgtttaccagcaaataggactcggaccaattgaagaagacactattcttgtcatagatccaaataatgctgcagtactccagtccagtggaaaaaatctgttttacttgccacatggcttgagtatagataaagatgggaattattgggtcacagacgtggctctccatcaggtgttcaaactggatccaaacaataaagaaggccctgtattaatcctgggaaggagcatgcaaccaggcagtgaccagaatcacttctgtcaacccactgatgtggctgtggatccaggcactggagccatttatgtatcagatggttactgcaacagcaggattgtgcagttttcaccaagtggaaagttcatcacacagtggggagaagagtcttcagggagcagtcctctgccaggccagttcactgttcctcacagcttggctcttgtgcctcttttgggccaattatgtgtggcagaccgggaaaatggtcggatccagtgttttaaaactgacaccaaagaatttgtgagagagattaagcattcatcatttggaagaaatgtatttgcaatttcatatataccaggcttgctctttgcagtgaatgggaagcctcattttggggaccaagaacctgtacaaggatttgtgatgaacttttccaatggggaaattatagacatcttcaagccagtgcgcaagcactttgatatgcctcatgatattgttgcatctgaagatgggactgtgtacattggagatgctcataccaacaccgtgtggaagttcaccttgactgagagtatggttttcacagtattattgttcacattttccctcagtttgattgcttaaaagcatatgaaaca

SEQ ID NO: 309252 - DNA, 1739 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagagccctcagctgccacaggctttctaccctgtggggcatccagttgatgtaagttttggtgacctactggctgcaagatgtgtattcactggtgaaggaaggacagaagccacacacattggtggcacgtctagtgatgaaatgtgcaacttatacattatgtattacatggaagccaagcatgcagtttctttcatgacctgtacccagaatgtagctccagatatgttcagaaccataccaccagaggccaacattccaattcccgtgaagtctgatatggttatgatgcatgaacatcataaagaaacagaatataaagataagattcctttactacagcagccaaaacgagaagaagaagaagtgttagaccaggatttccacatggaagaggcactggattggcctggagtatacttgttaccaggccaggtttctggggtggctctagaccctaagaataacctggtgattttcccacgggcactcaactgaggaccctcgtt

SEQ ID NO: 309253 - DNA, 1464 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttaggtaaggtagtaagtggatacagagtaagaaatggacagtggacactgattggacggcagtaaagagaaactttgtgctacatgacgacaaagctgctaaatctcctatttttttaaaatcactaacattatattgcaatgaaggaaataaaaaagtctctatttaaattcttttttaaattttcttcagttggtgtgtttttgggatgtcttatttttagatggttacactgttagaacactattttcagaatctgaatgtaatttgtgtaataaagtgttttcagagcatta

SEQ ID NO: 309254 - DNA, 1334 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactggaagttactggttttgtgatgaaggaacctgtacagataaagccaatattctgtatgcctgggcgagaaatgctccccctacccggctccccaaaggtgttggattcagagttggaggagagactggaagtaaatactttgtactacaggtacactatggggatattagtgcttttagagataataacaaggactgttctggtgtgtccttacacctcacacgtctgccacagcctttaattgctggcatgtaccttatgatgtctgttgacactgttatcccagcaggagaaaaagtggtgaattctgacatttcatgccattataaaaattatccaatgcatgtctttgcctatagagttcacactcaccatttagaaggaaggttgtagggatgatgataccaataagcaaatgatgaaacaaacaaaggccttccttctcaagatttggtgtgtgaactaggagtattttttttcccgagactgagcctcccactgtctgttgcccaggctagagtgcagtggcatgatcttgcctc

SEQ ID NO: 309255 - DNA, 1169 bp, Homo sapiens
caactaactccgcccgccgctccgccgcccgcaggctccggcttccgtcccggacagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtttaaagaaactaccagaccattttccaatgaatgtcttggtaccaccagacccgtagttcctattgattcatcagattttgcattggatattcgcatgcctggggttacacctaaacaggctagcttgactttgagtttaaacctcactgcagaaggggagaaaaccaacagccttttgggcaccagctggtgggatatctattatactctttttgagaaaatggatccaagctcttcgcgaagcagctgtgcgattgctgggaagtgcctaaagaagatccccatccaactccaggagccccatggatttccttatcacctctgtgtggtcagcagccatggtccagcctaccttccctagtgctgtgatctgtccaccactacaggcccgaccctcgtctaattgaatctgtacagcagaatagacatagcaaatgagggttacttcttgagtcaaatacatttgattgggaagagctgcctggaaagtgttaagaattatgagaccacattgggacttgatgggaaacggtgcagcgacccataaacaacatctgccacgaatgtgaaagataaaagtcgctccagtggccagcctctagaaagaagaatcctgggtgaagattgatt

SEQ ID NO: 309256 - DNA, 1225 bp, Homo sapiens
agcggagagcccgtggtcgcgcaggttctgaatgatgactgacgcgggtttgggtgatacccctcacagcccctgtcattccggagtcataaggcacccgcgcgtctagccccagcgccagggcacgcgagcggcgctggagggaggaaagcttccgcctgcgggccggacaaaagtcccgcctgcccacggctttttgcccgccgctcgtgaccgagacgcctcgccgcggccagctcgctgctctcgctggcggatggtgtgtggccgccgcaggacgcccgccgtgcccgggccatgaagtagcggctgctggcggcgccgctgcccaaccgccagccccagccccgcgctgcgctgcccggtcctctcccggcggggtcgtatcggcgtggacatggctggccgcgtccctagcctgctagttctccttgtttttccaagcagctgtttggctttccgaagcccactttctgtctttaagaggtgggtgttcgttgttcgggtgctttctgtgcatgctgttgagaaatgtaatcacttttatgaacctgagtgttggcaaaatagacggggttgatgttctttgctggaatgacttggaattttaccacagtaacttcttgtgaagtcacccgtgcagaaaaagcccactgcattgtagccaagcagttctggctttcaaaactccaattagaagttgtgatttccaaaactaatcactccctctgggggaggtatttcaggaactacaatatattcgcttagttttgaatgcctgcttgtttataacagctcgaagaataaaatataaggatacatcagtgtcgaggagaagcagatcatagactgtaatagctcacaaggaaacactgagctgtatacaaacgcctcataattactttattaaatatttatgtacttgtacatttgtaattcacatcgcagtcttttatttcttcctcctaacagctctgcctcctagcaagattatggttggctttcttgtttctagctagtaattctggacactgaaaatagttacagaaatttttactgggtcatggttaatatttctgccattagaaaattggcatgcctgtgataatttgtaatgtattaatactatatcttcattaacttgaaacagatatatgttttgacatatttttatatgacataattttttataaattttcaataaaaacaagtttttattgaatgg

SEQ ID NO: 309257 - DNA, 307 bp, Homo sapiens
catgagaggggtaatgctattcttgtcagagacagaattcacaaattccacagactagtatctaccttgaggccaccagagagcagagttttctcattacagcagcccccacctggtgaaggcacctgggaaccagaacacacaggaggtgcgtgtagggtttcttttaagcagtaaagtgtgaaatgctacaatccacgttagcaaaacctgaagggaataagaattaatgggtgaaaaaattcatcaatgaaaaggacttatcattagaaaaaaattactcagatttgggctatcagataacatc

SEQ ID NO: 309258 - DNA, 835 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaataggtaatgcaagatcctgtcttgtttttaatccattgctattagatatttaattagaattatctttgtatatgctacttggatgataaccattttaaggatttatatatagacatttgatttccagctttgatacaatgtcttagagttaaattatttattgtttcttgtatggttttgcatttattaaatgaattttaacatttgt

SEQ ID NO: 309259 - DNA, 4758 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggcctta

SEQ ID NO: 309260 - DNA, 3369 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaagtccccaggtgcatccaatttttcaactttaccaaagatctctccttcatctctatcaaataattataacaacatgaacaacagaaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttg

SEQ ID NO: 309261 - DNA, 3282 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttg

SEQ ID NO: 309262 - DNA, 2362 bp, Homo sapiens
  misc_feature (107)..(107): n is a, c, g, or t
  misc_feature (1114)..(1114): n is a, c, g, or t
  misc_feature (1674)..(1674): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaaaaagccactagagcagagttgctagtgaacagtttaatttccacatacgtcacagaaagagagctaaagggctctggttatcatccacagactgaccagtcaacccctaaataacctgatattaactccacaaatgttagctagattggaccatgtgtaatctgagtcagaagtcggaatcagaagagataaatgatgcgttatcactcaacagtaatgtctgcaacagtattgtaaaattgttgtactttacctgtcgaccacatccatccttanctctctgatcaccttactatttaaggacagtccctctactctacctgtagtatttatctcaatgcttcctggtccttgctttttcttttattatctcctctctcctacatatataaatgcctagcatagtgccacacatatggtaaacaccagtttattatttttatttcttttctaatgtcatcttccccctcagcctatgaatataaacacatcttcatctttaaaaccaaaaaccatatacttcctccatttaccatccttaagcttttttttctttgacagccacctacatttaaaaggctatacttaatgttgcttgccacccattcaggatttaacaaagttcttatttgtctttcttttaacctagtttatttgacctgtctttagtatttctttttgataaccatcttctaaagaaattctctgaatttgaatgcatgatacgaccttttatgccaaggactttgcctctctgaccagtcctttgtctgtctagctcggttcctctttagggttgccacatttagttttgcaaattgtgcacagctctaggnggcatcattcatatcatatgtagtctatgtgataggccctccttggcacggtgcagtgcagcttcactaactgtttgcagcagctctactcagaccttaaatgcattgacattcactaaatttctgtcagaagacctcttttatcataccatagtaggtgttcaaaattaggtgattctatgctaatcctctcccccagctcaaactgacacaaaatatgccattctgtatttctagactagaccacttttctgaattccagatttttcataaatttcatgtaggactcaccacctcaaattaaaccaaatctttttacccctccttctcccatcccctcaacctaaactgtcttcatttcctgtattgcctatttcaagtaccatccaagagccatcctgagttcctcctccagcctttcttctcttgtctagttagtcagcaagtcttgcagattctgcctcctcacctgaagttttcaaacagtacccctttacattcttgaaaattattaaagatccaaagaacttctgttatatgggttatagctgttaatatttgtcatattcgaaattgaaataagattttaaggtattttaaaataacagtacaaaaccattgtattttgacatgaataacacttttatgaaaataactatattccaaaacaataaaattaccaaaaagt

SEQ ID NO: 309263 - DNA, 2525 bp, Homo sapiens
  misc_feature (1277)..(1277): n is a, c, g, or t
  misc_feature (1837)..(1837): n is a, c, g, or t
ccaattttggtatatgtgctgctgaagcgagcactagaatgttatttttaaagctaagtttctgatattaggtacatgagggttaatgtatgtttcaaaatttctgtaataaagtttaaaaatgggttgcaagttttggtgcttagattcataattggctgaaaaaattattgtaatttcatttatttaaaatggaacattttgtgttatcaaatattatatgtaaaagtaagcagtcaaaataaggaaaaatagagctatgaaaaacaatttatatatagtataaatctacttaaactctcttttgtgtatctttaagtacctaacaccctacctggcatataggaagcatacagtaaatgctgttgaactgaactaatctgtatcttacaacagtaaaagtgtttaattttttaggagatttagaattttctttttctttcagaacttgtcttagaatgttgattagaaatggagagtgtaatgttggtctgttttagttactaagctaatttttgttttatgatgttaggttgtatgaagttacgttgttttacaatgttgggtttgaaaatataaaaatctttaaataactgttttgctgtctcaacgttcagacttaacttctctgtattttggttgcttaatatggtggtagatttccatgagtgttaaatgtttagttgacttactaaaagcaagttatgtttttctattgaagtaagaggctcaacttagccttgaattgcatgtttttagttgaaacatattgggcatagggaaattcagatactacaaacttccatttgtcaggagtaaggctgaattttctgtcttcatgaaaccacttcagctaaatggaagtcttacctttttctgtctgagggcacgatatgttacacctagcccaaactggccaaaattagtttaattctaggtaagtggtttgatgtctagttaatgtatgatattcttagcacttttttttctcctttttctagaaagccactagagcagagttgctagtgaacagtttaatttccacatacgtcacagaaagagagctaaagggctctggttatcatccacagactgaccagtcaacccctaaataacctgatattaactccacaaatgttagctagattggaccatgtgtaatctgagtcagaagtcggaatcagaagagataaatgatgcgttatcactcaacagtaatgtctgcaacagtattgtaaaattgttgtactttacctgtcgaccacatccatccttanctctctgatcaccttactatttaaggacagtccctctactctacctgtagtatttatctcaatgcttcctggtccttgctttttcttttattatctcctctctcctacatatataaatgcctagcatagtgccacacatatggtaaacaccagtttattatttttatttcttttctaatgtcatcttccccctcagcctatgaatataaacacatcttcatctttaaaaccaaaaaccatatacttcctccatttaccatccttaagcttttttttctttgacagccacctacatttaaaaggctatacttaatgttgcttgccacccattcaggatttaacaaagttcttatttgtctttcttttaacctagtttatttgacctgtctttagtatttctttttgataaccatcttctaaagaaattctctgaatttgaatgcatgatacgaccttttatgccaaggactttgcctctctgaccagtcctttgtctgtctagctcggttcctctttagggttgccacatttagttttgcaaattgtgcacagctctaggnggcatcattcatatcatatgtagtctatgtgataggccctccttggcacggtgcagtgcagcttcactaactgtttgcagcagctctactcagaccttaaatgcattgacattcactaaatttctgtcagaagacctcttttatcataccatagtaggtgttcaaaattaggtgattctatgctaatcctctcccccagctcaaactgacacaaaatatgccattctgtatttctagactagaccacttttctgaattccagatttttcataaatttcatgtaggactcaccacctcaaattaaaccaaatctttttacccctccttctcccatcccctcaacctaaactgtcttcatttcctgtattgcctatttcaagtaccatccaagagccatcctgagttcctcctccagcctttcttctcttgtctagttagtcagcaagtcttgcagattctgcctcctcacctgaagttttcaaacagtacccctttacattcttgaaaattattaaagatccaaagaacttctgttatatgggttatagctgttaatatttgtcatattcgaaattgaaataagattttaaggtattttaaaataacagtacaaaaccattgtattttgacatgaataacacttttatgaaaataactatattccaaaacaataaaattaccaaaaagt

SEQ ID NO: 309264 - DNA, 670 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaagtgtcaacactcaaagaatggacgaaaagaaagcaaggatataagcagaaaatacgatggaatcaaaatccaagagaaacagcagacaatagaaacagacccataagaaacccaggtaattgagttagtagattttagaatagtgggcttattatgcttaaaaaaaaa

SEQ ID NO: 309265 - DNA, 1028 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtaagagaaaggggttgagatgcccgcggttgcccgaggatagtggagaagtgggcgggagccgcgagctggttctttcgctagtgacaggtgcgggcaggtccggcggcggccgccggggcagcgggattttggccgcttctgaaatgttggggcaaaggttggactctagatgagggtcagggttcttggcttgccagggcatgctgaaaggtatccggggagcggcggcggcggcggttctgactcgtgcggttctcttcgtcctccttccttccgtagtgccgctcccacctcaggccttcccgaatgataggttatagtggtttggtttgagtcttatatacgccgttttgacaggtcccggtgccgcggcttatcacgatctcaccggctttacttctctgttcatttcctttcctagaattgtcggcgtccaagttcccttttattctgattcttggtcttccgggaggcaggctgcaggatgtttgcggtctgtactacacaggtggcatgtcagggctccacataagagaaagaaaccctagtttccagttccttgtcaaaggagggagaggagtagggaaccttgggcttatgagagaccacgtggtcttgtgctttagtggtggcttgatagaagccggcagcgtttctgttagacgtgcagcccttcccttctgtttgaaagataatgtaggcctgcaaaaagtagataagtccacttgaggcttaactaactgctaatattcaaacttgtaaaataccaaaggttatacat

SEQ ID NO: 309266 - DNA, 449 bp, Homo sapiens
tgtatgattttgaagcccttgatgctagataatcaaatccacaatgatagaagaacctagatgtgtattgcagaaattcatgccttgtttatatttgagtattttgttcttagtatacaagctatctaaatttgctcttaattaatatgttactattttaaaagcctccaattcaaatatcttaaggcatagtataaatgtatggtataaatgagaaagttgcgttgtctgatacagtcaaatcattaaacatttgtttaatttcttgaagctttttcgtggtttttaaaagtatcttaaaatatttctttatcaaaatgaatctgatgtgaaagtaatatatttattcaaatgaaaagttttagaataaaaaagaacaaatagaggtagaggagtatatgaggtatttttgagggtaaatgaaagaagaattaggaatctttttatct

SEQ ID NO: 309267 - DNA, 387 bp, Homo sapiens
gaatttcatttgcattttcactgtggcccacatgactgatgcaggtggaactcaaagaagtaaatagaccagcttatagtgtctgaagcccaactttcaatgttacccatctctgattgcattaaagaatctaggattggtggttcccctagctataatgcagaaaccaagttaaacatcttcctgtacctcaaagatctctaaaatgcgtcatttatagtgtcaacactcaaagaatggacgaaaagaaagcaaggatataagcagaaaatacgatggaatcaaaatccaagagaaacagcagacaatagaaacagacccataagaaacccaggtaattgagttagtagattttagaatagtgggcttattatgcttaaaaaaaaa

SEQ ID NO: 309268 - DNA, 281 bp, Homo sapiens
  misc_feature (15)..(15): n is a, c, g, or t
  misc_feature (52)..(52): n is a, c, g, or t
accagaaacaacagntaacgtggctcaactcaaggaaggctcctggtgggantcggtcgtgtgtgtagtatacgtgagcgtacctcaaagatctctaaaatgcgtcatttatagtgtcaacactcaaagaatggacgaaaagaaagcaaggatataagcagaaaatacgatggaatcaaaatccaagagaaacagcagacaatagaaacagacccataagaaacccaggtaattgagttagtagattttagaatagtgggcttattatgcttaaaaaaaaa

SEQ ID NO: 309269 - DNA, 3515 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaagtccccaggtgcatccaatttttcaactttaccaaagatctctccttcatctctatcaaataattataacaacatgaacaacagaaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagttaccggtttactaaaatagtgagcatacatgatcacttgagaattgggcttctggagcacctgaacagaaagggagtggttcatattcagcattacaaaagacaactttctctttttgaaggggattactttggctattttccagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttg

SEQ ID NO: 309270 - DNA, 4937 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaagtccccaggtgcatccaatttttcaactttaccaaagatctctccttcatctctatcaaataattataacaacatgaacaacagaaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagttaccggtttactaaaatagtgagcatacatgatcacttgagaattgggcttctggagcacctgaacagaaagggagtggttcatattcagcattacaaaagacaactttctctttttgaaggggattactttggctattttccagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggcctta

SEQ ID NO: 309271 - DNA, 5249 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaagtccccaggtgcatccaatttttcaactttaccaaagatctctccttcatctctatcaaataattataacaacatgaacaacagaaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagttaccggtttactaaaatagtgagcatacatgatcacttgagaattgggcttctggagcacctgaacagaaagggagtggttcatattcagcattacaaaagacaactttctctttttgaaggggattactttggctattttccagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgattaattatgtttcctttaattttttggatgtgagttgatgacaaatgttaaatttgtggatgttggtcatttattttgctctaataatactgcaagaaaactatggctgaacttagtttttggataatctagttcatgtgcattaggctgccgtatatactactatgatatttagctgcagtatcaatgtggcataaatactgcggcagcattcttcgaaaaccgcattttcaaatttatccccgtaatcaatgtgggcctattaaaaaaccaaatcatgatacaagaaacaaccttggaaaagttatttccctttgtaatacctttaaaaatccagagtattatattcattttactgccactgtggaaacaggttctagatttcatactccatctaaagtcatttttcagttacatgtaagtattatttactgctattgggatctattcttcagatattcaaaaacattttttgctttaaaatgcatatctttaattgggtgttggtccaaaattaaaatttttgctgtctgtttttctctaccccattttgtggtaatttggcaacttgagctctcccaattattgtaatataaggacagacataatagtattctgtacccatagtaataattgcatcaagcttagatgagaaatttttttcatatactggcctttaaatcattaatggacaattggctataaaggtaggtctgttaactttctttgtgtgttcctgatggaattcaccatagccttacagcttttctcagaaggtaacttgttataagagaaatggcatttgcatgttccagagtcagaacctgtacagtatataaagcataaacaccttgaatttgattttagttcaccacattcaaggatccaggatgccaaaaatatgtgtgaacatttgaaacatttttatttgctgctttttccctttgatatagttgaaagaatgtattgtaaattggcatacaatactgcctttaatagaaaacctaaatgctggggcacatttcacatatcgactacctgagaaattgctttgtgtcccactgttattaaagcaaaaagtataatgttcttcacttgaactaatcaaatacaatagattataaattgtgtattgtaaataaaagttcactctgtgagtgcacattttggtaaattatttatttatgttagcatttaaaagtttaaaaaaaatgcatttgaccaggataaatgaggtatgttgatcatggctttgctttatatcttgatattaaagctggtttatcatcctggtattttaaaagctgctttggggttttttttttcttttttttttttttaatgtaaactaacctcctgcatgacagaggttaaaattttgtctgcacttgagttcacttgagtttacatttgaaatgtgcatgtttatttatatagatttcaataaagctattcaaggccttatttagtcttttatttcttactcttaatcttttaataaaaatcccctactttatggttagatgactatatgctagactttttagttataaatagttaatactagaaaggaaattatgtcagagcaaaatgaatcctactattaaggacgttttaaagttgatttttgtccactttaatatttattcattaaacatatgtttgtgtaccaatcactgttgtagagtctggagatacagcagtaaacaaatatccttacct

SEQ ID NO: 309272 - DNA, 3434 bp, Homo sapiens
atggactgttgaaaacattaataataatttttatggagttgaaaatgtgtatagaattaactacacaatagtgttagcatgtaagttaagataatattctctactatgttccctggtgatccccagctcctcatatccatattcttgggcactcttcttccatgttgtactgaggttggtctgtgtggccaatagcatatagcagtactcatggtacatcgctttcgagattaggttataaaaaaacaccgcggcttacatcttgggtgcacacgcactctagctgtctctctttctcatttctcactcggggaattcaactgcatatggcgaggacactcaggcagcctatggagaggcccacatggtgaggaactgagatctctggccaatagagaggaacggaggcctgcaacaaccatgtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaagtccccaggtgcatccaatttttcaactttaccaaagatctctccttcatctctatcaaataattataacaacatgaacaacagaaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagttaccggtttactaaaatagtgagcatacatgatcacttgagaattgggcttctggagcacctgaacagaaagggagtggttcatattcagcattacaaaagacaactttctctttttgaaggggattactttggctattttccagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttg

SEQ ID NO: 309273 - DNA, 2211 bp, Homo sapiens
gggaggttgaggctgcggtgagccaagatcatgccactgcactccagcctgggcaacagagtgagtagagcctgtctctaaacaacaaacaaaaaaagatagcaaaagtgggagcagtttcaagtaatgacaggatctaataagttgactgaggttgaattaatgcaagtgtctttgaattgaggagccaaggaatgataaaactaggacaaattatccatgtgggcattgtcacacaggacccaggatagtggcaagattggagacaaacactaatccaaatgccaaatgaatgtgagatagcaaccatgaggtcactctcatttactgaattttttttccaaaataataaattcattacaattttttttgttttttagtacaaagtggttgtccccaaaattggaaacatattagatctttgtacagcattgtctgctttgtcaggaatacctgcagataaggtaagatgtttctggggttgaagtatataagttggtatttagtttctcagtgctgtaaaaccagcttaatagaaattcgtttccttttagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttg

SEQ ID NO: 309274 - DNA, 3411 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaagtccccaggtgcatccaatttttcaactttaccaaagatctctccttcatctctatcaaataattataacaacatgaacaacagaaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagttaccggtttactaaaatagtgagcatacatgatcacttgagaattgggcttctggagcacctgaacagaaagggagtggttcatattcagcattacaaaagacaactttctctttttgaaggggattactttggctattttccagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaaatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttg

SEQ ID NO: 309275 - DNA, 996 bp, Homo sapiens
gaagaagtggatatccatattgaaaaaaaaaacaaaaaattttgattcaaaccttgcaacatatacaaaaattaactcaaaatggatcacatatctaagtataaaactataaaacttctagaaggaaacacaggacaaaccctggtttacgaaatgtttccttagatacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtccaaagcagcatatgtactcttctaccagagacaagacactttcagtggaactggcttttttcctcttgaccgagaaactaaaggtgcttcagctgccactggcatcccattagaaagtgatgaagatagcaatgataatgacaatgatatagaaaatgaaaactgtatgcacactaactaatgaaagtcctagaagccataaaagagacactttcctgctggtggtatctatggaaatgatgaagttacccaccacattaaaacaaaagtctgagatggggagtttcagataaccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttg

SEQ ID NO: 309276 - DNA, 3398 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccactgaataaaccagacagcaccattcaggatgctggtttataccaaggacaggtattagtgatagaacagaaaaatgaagatggaacatggccaaggggtccttctactcctaagtccccaggtgcatccaatttttcaactttaccaaagatctctccttcatctctatcaaataattataacaacatgaacaacagaaatgtgaaaaactcaaattactgtcttccatcatataccgcttataagaactatgattattcggaacctggaagaaacaatgaacagccaggcctctgtggcctaagtaacttgggaaatacgtgtttcatgaactcagctattcagttaccggtttactaaaatagtgagcatacatgatcacttgagaattgggcttctggagcacctgaacagaaagggagtggttcatattcagcattacaaaagacaactttctctttttgaaggggattactttggctattttccagtgtttgagcaacacacctccacttactgagtatttcctcaatgataagtatcaagaagaactgaattttgacaatcccttaggaatgagaggtgaaatagctaaatcttatgccgaactgatcaagcaaatgtggtctggaaagtttagctacgtcaccccaagagcctttaagacacaggtaggacgttttgcacctcagttctctggatatcagcagcaagactgtcaagaactgttagctttcctattagatggattacatgaggatttgaatagaattaggaaaaaaccatatatacaattaaaagatgcagatggaaggccagataaggtggttgccgaagaagcctgggaaaaccatttaaaacgaaatgattctatcatagtagatatatttcatggccttttcaaatcaactttagtttgtcctgagtgtgctaagatttcagtaacatttgatcctttttgttacttgacacttccattgcccatgaaaaaagaacgcaccttggaagtttacttagttagaatggatccgcttaccaaacctatgcagtacaaagtggttgtccccaaaattggaaacatattagatctttgtacagcattgtctgctttgtcaggaatacctgcagataagatgatagttactgatatatacaatcatagatttcacagaatattcgctatggatgaaaaccttagtagtattatggaacgggatgatatttatgtgtttgaaattaacatcaataggacagaagatacagagcacgtgattattcctgtttgcctaagagaaaaattcagacactcgagttatacccaccatactggttcttcactttttggtcagccctttcttatggctgtaccacgaaacaatactgaagacaaactttataatctcctgctcttgagaatgtgccgatatgtcaaaatatctactgaaactgaagaaactgaaggatccctacactgctgtaaggaccaaaatattaatgggaatggcccaaatggcatacatgaagaaggctcaccaagtgaaatggaaacagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatgaaagatcttttcttgctttggattgggatcctgatttgaaaaaaagatattttgatgaaaatgctgctgaggactttgaaaaacatgaaagtgtggagtataaacctcctaaaaaaccctttgtgaaattaaaagattgcattgaactttttacaacaaaagaaaagctaggtgctgaagatccctggtattgtccgaattgtaaagaacatcagcaagccacaaagaaattggatttatggtccctgcctccagtacttgtagtacatctcaagcgattttcttacagtcgatacatgagagacaagttggataccttagttgattttcctatcaatgacttggatatgtcggaattcttaattaatccaaatgcaggtccttgccgctataatctgattgctgtttccaaccactatggagggatgggaggaggacactatactgcttttgcaaaaaataaagatgatggaaaatggtactattttgatgacagtagtgtctccactgcatctgaagaccaaattgtgtgttgggcccataacccattaaaggccagtgagtccagaagggaagtctgctggtgtacttgtgggaagtttttctggaggaaagaaaaaatgatccttctttaacagatttctgtctacatgtgattcctggaatggcacagtggcatcttgggactgggcttgaagtgtgaaggtgtgttaaccttgagtatattcttttactttagtctttatgcctgataaccaaaactgtattcatctggggtggaaaatggccttttttctacttacttttatccctaaagcccacaagctttgcattgtaatatttgaacattaaaaacaaaaaaaa

SEQ ID NO: 309277 - DNA, 752 bp, Homo sapiens
  misc_feature (107)..(107): n is a, c, g, or t
  misc_feature (726)..(726): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtggttgaacagggtatgtttgtaaagcactgcaaagtagaagtatatctcacagaattgaagctatgtgaaaatggaaacatgaataatgttgtaactcgaagatttagcaaagctgacacaatagatacaattgaaaaggaaataagaaaaatcttcagtattccagatgaaaaggagaccagattgtggaacaaatacatgagtaacacatttgaaccgncggtgcggcgtggggtaccgagctcg

SEQ ID NO: 309278 - DNA, 777 bp, Homo sapiens
  misc_feature (107)..(107): n is a, c, g, or t
cccggggcctcctcttgtcccgaggagcacccccgctcccggtgtcttttggtttcgaccggccgactgggaggggccgtgggacgccattcccataatgctctggngcgtgccgccgccgtcgctgccacctcccctaccgctagtggaagaagatggcggaaggcggagcggcggatctggacacccagcggtctgacatcgcgacgctgctcaaaacctcgctccggaaaggggacacctggtacctagtcgatagtcgctggttcaaacagtggaaaaaatatgttggctttgacagttgggacaaataccagatgggagatcaaaatgtgtatcctggacccattgataactctggacttctcaaagatggtgatgcccagtcacttaaggaacaccttattgatgaattggattacatactgttgccaactgaaggttggaataaacttgtcagctggtacacattgatggaaggtcaagagccaatagcacgaaaggtacattttaataataactgactataaatattatttttcttgattagttcacattttattattaattcaatgaattgtgaagtttcatcacttatcttagagaaaaagccagcaaaataaccgtacactgtgttacaataatggcaagtaacatgttaagaaggtttacttatgctagccactattgtaagtatgtattattgattaatcctctatatatagagagaaaactctgtaaggtaagtagtaggaaatgaggataaaaagttaggat

SEQ ID NO: 309279 - DNA, 456 bp, Homo sapiens
cagatgagccagatgatgaatccagccaggatcaagaacttccctcagagaatgaaaacagtcagtctgaagattcagttggaggagataatgattctgaaaatggattatgtactgaggatacttgcaaaggtcaactcacgggacacaaaaaacgattgtttacattccagttcaacaacttaggcaatactgatatcaactacatcaaagatgataccaggcatataagatttgatgataggcagcttaggctagatggtaagtatttgtgaaaaatggcttgaacattaaacaagccgagcatgttattttttttttaggtgaaaaccatgaaattcagctctgtcaagaaatataccatttacttttctatctcaaattttacatgaaaggacttaatatctaagtagactaaaatgtgtgtttgtgtttcataaatggagattgaactca

SEQ ID NO: 309280 - DNA, 719 bp, Homo sapiens
aagattctataatttccattgtgataatgtaaatacacactaatttcaaaaccccaaataaattctacataatctgtaatttggaattatctgtgtcgcccttcgtctgcatttgcataaaaataagttacccaagatcctatgtaagtatgtttaacaactgcaaacatttattgaccatctgttatttacagagttctctgttcaacctacaaatacaaatagaaaatatattctctaaattcaaggaatttatattctgtttacttggtttaagttttcttatacttaatggaaccaatagtttctttacagtttatcttctaggattccttctcactatcattactgatttcttgttatttgaggtcttttagtctcacctgcctagctttggaatcgaaatgcagattacctgttcaccttgtctactgttttcctttaaataatcacagagttactttagtttcttagtttatccagctatcttctaaagttattttaacttcagagttatggaaaaacacccttttattgtgtcatatttgcaggtattagtgatagaacagaaaaatgaagatggaacatggccaaggggtccttctactcctaagtaagtgctcccacttcttatggcttattgtatgattttgaagcccttgatgctagataatcaaatccacaatgatagaagaacctagatgtgtattgcagaaatt

SEQ ID NO: 309281 - DNA, 1799 bp, Homo sapiens
atgagggcctcggataaacagtcccggatttgcagagggagtcgcctgagggtcccgttctggtcctgtggagaggtgaagctggctgggcttctgggtctggtggggacttggagaacttttctgtctagctaaaggtttgtaaacacaccagtcagcactgtgtctagctactggggtgggaacttggagaacttctctgtctagctaaagtattgtaaaaacgcaccagtcagtgctctgtgtctagctaaaggtttgtaaacgcaccaatcagcactctttaaaaacggaccaatcagcactctgtaaaatggaccaatcagcactctgtaaagtggaccaatcagcaggatgtgggcggggccaaataaggggcataaaagctggccaccgaaaccagcaagcgccaaccgtggcgggttctgttccaagctgtgggggctttgttcttttgctcttcgaactaaatcttgctgctgcttactctttgggccttcgctacctttacgacctgtaacactcactgccaaggtgtgtagcttcactcctcaagtcagcgagaccaccaacccaccgggaggagctaacagctgtgctacgcgccacctgtaagagctgtaacactcgctgcgaaggtcggcggcctcacggggaggaagaaacagctcccgacgcgccacctgtaagagcttaacgctcactgtgaaggtcggcggcctcacggggaggaagaaacagctcccgacgcgccacctgtaagagcttatggctcactgtgaaggtctgcggcctcaccgggaggaagaaacagctcccgacgcgccacctgtaagagctcactgagaaggtctccggcttcactcctgaagtcaggcaagaccacgaacccgccagaaggaagaaactccggacgtatctgaacatcagaaggaaccaattccggacacactgtttgcagggaggtgtagacgctgatcaccgtttccagtcattttaaaaattcaggttttatttatttactttttacagtagataggcccttcgggggttcaccccgccttcgccacagcccgcccagtgctcgcctctcttgctgcctcagagctccgcctttccttcccctcgcacacagccccgcccgctcccagcctggccccttgggttttccactgggggaagcacccccctccccgggggggcccagggcacccaacacctgcttgcagaaccctgctttctgggatgcgcttctcattaccgggcaggttaagcatgttccgtacatttagcagtggtttttacttcttttccaggaagttatctggtgaatattttttgactccttttatcttagtttctcttggggctttcgctgccttctagtattttttttttttaataggggaggcaggccttgttctgggctcagctttccccgtttgttgttcgtctttggactttgcgtgtggggcttctgacaatgactcttaatctttatgtcgtggaatgtgtcaatcctgactttatattttttgggtcttgtatcacagttcaaatggcctccccagaacaagatgatcttttctatactttaatgggttgatgaactttagacccggacaggcatttgaagacagtcatgaatttaagtataaatattagaaataggccaggcatgatagctcacacctgtaatcctagcattttggagaaccaaggtgggcaaatcccttgagctcaggtgtttgaaaccagcctagaccacacaccaagaccctgtatttacccacccaaaa

SEQ ID NO: 309282 - DNA, 8603 bp, Homo sapiens
  misc_feature (1291)..(1291): n is a, c, g, or t
ttcatgaatcctaacagaccaaaagtgttaaatgtgatcagccttgaattttcagatacaaagatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctggggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacagggtggatccatgctgtgctcacttctcaggactgtatggcttttggggggaacttcctgcacaaccttaacattggcatgcagctcaggtgttatgagatggagaaaaggctaaaaacaccagatcttttcaaattccctttctttgaagccatatgttggtttgtagccaaaaacttgctggaaaccctgaaagaactgagagaagatggtttccagcctcaaacttacctagtacagggagtgaaagcactgcatactgctttaaaattatggatgaaaaaagaacttgtatctgaacatgcctttgaaattccagacaatgttagacctggacaccttattaaagaactttctaaagtaattcgagcaatagaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaaagattagagatgtgtccatgggaagaggacatcttgagctctaaactgaatggaaaattcaacaaacatctccaaccatcctccacagtacctgaatggagagcgaaagataatgatctacgattactgctgacaaatggaagaataattaaagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatgggttttttacangtgtgaaatcagaactcaggagtagatcatcaggatattctgatatttctgagtcagaagactccggacccgagtgcactgcactgaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtggataccatgtcaagactgaagatccagacttgaggacttcctcctggattaaacagtttgatacttccagatttcatcctcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaaacgtccaaaaaaaggaatggcaacagccaaacaacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtagaaccttaaaaagagaccttgaactggaaagggtctcttgtcagggcttgaattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattagcttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgtctataaacaacccgtgtaaaccctgtctacactatgccaaaaccagtggaaagatgggtagagtcatcttatctcaggatgtcaaaaatctgggtttgactgattcccctaccttcccacacagtatattcttgtgatttttgcttttctgtagatcctgagtcggtgttacaatagtcatgtttttattttgggttaagaaatacgaggtgtaagagctataatttccttttcgtgttatatcatgatctgggttttcttttttcctttacgtttttcacagctcttgagtattttctatttttttctttagtcacaaaaattaaaattaaactttatttttatgaattaaaatgaaatttaatttatttttatgaattaaaattgtggccagtatccactgtgtccttaggctgagaagtactaatttggagtagcccgtgtgtggaattctaaagtgaaggtactgtggattcatttttagtagttttagccccttaataagtggctaagttagaaaactttcagcgaggtaatagaaccacttgaatagaatccatgtgtctttttctgaattggtgaaaattcggccactgatccagtgactcctggtcaaacgtcttataacattactggccataatgcatccctttatctcatggaaatggctgaactttgtggtagctgctgcgagtacctgggcttaacagtaatagagaacctcatttataccatacagacacagcaacttaggaagacagcactgatagcatttagctagttgtaaccaaatacaaatatgtaaaattgagaattatgattaacatatgcaactttagtaataggaatagatgataattttcctgtattgtttcaaataagtgactgttcagctgggatccattggattataatttacaatgtcacataatattatgcttttcaatattgatgagtgatgtaaacaatataaagttggcagtttgtagtagttcagtatcctagaaatacattgaacttcataagtatcagttcatttttaagcatacagaattgaagattctgactgaaatcataaactcagaggaaacaagcccatctttatcactaattacttagcttgaatacttttctatttttaaataatcctaattattgccttttcaattatagtctactgtatttatttatatgggatcaacaggtatttatcaaacatctactgtgtgcccagcactacctagtactgttggggaacatcaatttgcagttgtggtctctgcccttgaaggtatcttctccaggaaattagcagtattattttcacttctaagcaaacatgagcaaaagaggacctgttcattaaaaaacatgctgacttttttagtttcaactgagatatgccactgtagaagtgaaagtaatttcacaattaaagaaatgcttcaacttggtaattaatatggtcatacagggacttggtgtagcatgcaaggaagcagaagacctgggcttttgtcgaagttctgccatttaggtatcagctgtgtaaccttgaataagtcacttaactctttctcttagttttctcatttgtaaatttggattaaagtgtttattatgataatcaattaagaaaatctcttaacacttcatacatacagagaacttatcattaagttaaaactggcaattaatgcacctttatatatatttttaaatgaaaactaatactattcatgatgtttattttatatcaaatatatgcccagggcatgctactttaaaaatccgaggaatctccaacaaggtgctggattaaaatcagatttcgtgcttgaagtggaagaaaaatgaagttgtttatggataagagagtgagaatgtgtatcctcaagtacgttaagatgatttaactgaaagatggctttaggtttttcttgaagaattaggaaagtaccatccccacagattcagcatactcttcaggtactagataaaggtgaaggaagtcatggaattaaaatgacttagcaactccccagggaacttgtggggagaatgaggtggttagaaaggtgagaatgcacaaagacagctctgggttgggtaccaacagtttgcttggtagaaagaaaccagtgtaggaaaggagacgccaccagacatcttcaacagacaagattctttctgcctttttcaaaagatgctctctgcagcagtaagactatagatagagttgattggaatatcatgtgacccagtatgctactgctaggcataattatcaaaaattcatttttctcattaaatattgttaattgctcgccacataaagagaagctagagctcaccagtcttggtggtgtcctagaccttcctctaaagcagtcttgggaagctggatcatcagatctttagcctagacagagtgtcgctggtaaataaaggagacacaggtaacccagagtggacagtgatttgcgtggggagacacagtggatctggggcctctgatactttgcttcctaaaacagcccccagttttcggcttgccctatgagatgatgttcatgtgcttccttgaaaccaggtggaaagaaaggggaagaattaattttctcattctgttgctgttgaacgtaatgtaatcttaatactgtagccttcctagaagcccttccctctttttcatgctgtaaagtcaaatatttgatatccttaacataaattttaaaaattaaggtcattaggaagcaaatgtctatttccaaagcaatgagcttgttgtgactgtgattttattcttctatagtatttttttcctcattttaactgagaggagaaaataatactcttttgcaatatccttaggttctccccttccccctggtgccccttctagtgtcttaagactttgtcttaacaagtataacattacattttgttgttaaaacctttcgaaactgtattcagtgattcttccaagtttatctgctctgcactatttcactaataaaccctggctaccacgtagcccttgatctccaagtagtttacctatgcaagacctgtgacactctgaattcacttctctttctttcagaaagtagtcataaatggagcttaattataaaggtaaaacttgtctccaaccagtttcattttggccatttctttttcaaaatgtcagctgttttcctccaagatttttcaccaaaacaatgatcataagtgctggaatatataatactttgcaggcataaaataacccagacatactctcatatttctttggtgtattttggttggtaaaacttaccagcattaaatgtaaaatataatgaggagttaattccttacctagaactatttcttccttttaagattcataagtaaccttttatttttacagagctacgtataacttccacattacagtcagggacctgaggtgtaacttactaagtgaaccccaaggttattttatcttgcaaaagaaacctaaaccaaactaagggccttacagtttatggttagactgaatcaaaagctataacctcaatttttccaaaaacagcttctgactgcaaaagcaagtcatacagttgttaggtatgaaatagcactgatcaggaaatgcatcttcgcagatggtatttccttcagaaaagacttttctacttttaatataaattaagccataacagtttcatgctgtggaaagagggtgaaaaggttcattttaagagattatataatatgaactttcacatttactgtgaaatgtctaactttgccagtgcttcagcaagtttttttggggggtgatggggaggggtagtattggttttagaggtttcaaatctgtgaactttggagaggggacagttgttggctctggtatttactagttttgtagtaacgttttgctagcctgactgacttttcttactggtttttatgcccacggtccgaggggactgttcttcttgtttggggtgtctgcggaatagcgtctcgtcttgtttgtataggcagtcaatgtgtgtgacatgtgtgtcctttcagtccggaagcccactgtgtgacaatggcgtggggtgtggctgggaggtggggtgctgaagcttgaagagcatttctttgctgattcataacagtatttcccatcttttgcctgcaggcagggaaagtgtacagtatttattttgtttctgttttactttaaatttgtaagtctttaagtagcttacattgattattataggggaggacaagtgacttgtttaaagttgtatttagtattctttccaatttctgtattttaaaatattgaaattaaaattgtattacttctgttttgatttttttagcactcagtgtattttttgctcattttgtttgaaagtataaatgttgaaaattgtataaaatgcgtccttgaaagaaaaagaatctgaattctatatccaattctgactttgttccctttttctgctgattgaatcatgggaaattatttaaaagtatgaaaaactggg

SEQ ID NO: 309283 - DNA, 8425 bp, Homo sapiens
  misc_feature (1291)..(1291): n is a, c, g, or t
ttcatgaatcctaacagaccaaaagtgttaaatgtgatcagccttgaattttcagatacaaagatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctggggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacagggtggatccatgctgtgctcacttctcaggactgtatggcttttggggggaacttcctgcacaaccttaacattggcatgcagctcaggtgttatgagatggagaaaaggctaaaaacaccagatcttttcaaattccctttctttgaagccatatgttggtttgtagccaaaaacttgctggaaaccctgaaagaactgagagaagatggtttccagcctcaaacttacctagtacagggagtgaaagcactgcatactgctttaaaattatggatgaaaaaagaacttgtatctgaacatgcctttgaaattccagacaatgttagacctggacaccttattaaagaactttctaaagtaattcgagcaatagaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaaagattagagatgtgtccatgggaagaggacatcttgagctctaaactgaatggaaaattcaacaaacatctccaaccatcctccacagtacctgaatggagagcgaaagataatgatctacgattactgctgacaaatggaagaataattaaagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatgggttttttacangtgtgaaatcagaactcaggagtagatcatcaggatattctgatatttctgagtcagaagactccggacccgagtgcactgcactgaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtggataccatgtcaagactgaagatccagacttgaggacttcctcctggattaaacagtttgatacttccagatttcatcctcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaaacgtccaaaaaaaggaatggcaacagccaaacaacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtagaaccttaaaaagagaccttgaactggaaagggtctcttgtcagggcttgaattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattagcttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgtctataaacaacccgtgtaaaccctgtctacactatgccaaaaccagtggaaagatgggtagagtcatcttatctcaggatgtcaaaaatctgggtttgactgattcccctaccttcccacacagtatattcttgtgatttttgcttttctgtagatcctgagtcggtgttacaatagtcatgtttttattttgggttaagaaatacgaggtgtaagagctataatttccttttcgtgttatatcatgatctgggttttcttttttcctttacgtttttcacagctcttgagtattttctatttttttctttagtcacaaaaattaaaattaaactttatttttatgaattaaaatgaaatttaatttatttttatgaattaaaattgtggccagtatccactgtgtccttaggctgagaagtactaatttggagtagcccgtgtgtggaattctaaagtgaaggtactgtggattcatttttagtagttttagccccttaataagtggctaagttagaaaactttcagcgaggtaatagaaccacttgaatagaatccatgtgtctttttctgaattggtgaaaattcggccactgatccagtgactcctggtcaaacgtcttataacattactggccataatgcatccctttatctcatggaaatggctgaactttgtggtagctgctgcgagtacctgggcttaacagtaatagagaacctcatttataccatacagacacagcaacttaggaagacagcactgatagcatttagctagttgtaaccaaatacaaatatgtaaaattgagaattatgattaacatatgcaactttagtaataggaatagatgataattttcctgtattgtttcaaataagtgactgttcagctgggatccattggattataatttacaatgtcacataatattatgcttttcaatattgatgagtgatgtaaacaatataaagttggcagtttgtagtagttcagtatcctagaaatacattgaacttcataagtatcagttcatttttaagcatacagaattgaagattctgactgaaatcataaactcagaggaaacaagcccatctttatcactaattacttagcttgaatacttttctatttttaaataatcctaattattgccttttcaattatagtctactgtatttatttatatgggatcaacaggtatttatcaaacatctactgtgtgcccagcactacctagtactgttggggaacatcaatttgcagttgtggtctctgcccttgaaggtatcttctccaggaaattagcagtattattttcacttctaagcaaacatgagcaaaagaggacctgttcattaaaaaacatgctgacttttttagtttcaactgagatatgccactgtagaagtgaaagtaatttcacaattaaagaaatgcttcaacttggtaattaatatggtcatacagggacttggtgtagcatgcaaggaagcagaagacctgggcttttgtcgaagttctgccatttaggtatcagctgtgtaaccttgaataagtcacttaactctttctcttagttttctcatttgtaaatttggattaaagtgtttattatgataatcaattaagaaaatctcttaacacttcatacatacagagaacttatcattaagttaaaactggcaattaatgcacctttatatatatttttaaatgaaaactaatactattcatgatgtttattttatatcaaatatatgcccagggcatgctactttaaaaatccgaggaatctccaacaaggtgctggattaaaatcagatttcgtgcttgaagtggaagaaaaatgaagttgtttatggataagagagtgagaatgtgtatcctcaagtacgttaagatgatttaactgaaagatggctttaggtttttcttgaagaattaggaaagtaccatccccacagattcagcatactcttcaggtactagataaaggtgaaggaagtcatggaattaaaatgacttagcaactccccagggaacttgtggggagaatgaggtggttagaaaggtgagaatgcacaaagacagctctgggttgggtaccaacagtttgcttggtagaaagaaaccagtgtaggaaaggagacgccaccagacatcttcaacagacaagattctttctgcctttttcaaaagatgctctctgcagcagtaagactatagatagagttgattggaatatcatgtgacccagtatgctactgctaggcataattatcaaaaattcatttttctcattaaatattgttaattgctcgccacataaagagaagctagagctcaccagtcttggtggtgtcctagaccttcctctaaagcagtcttgggaagctggatcatcagatctttagcctagacagagtgtcgctggtaaataaaggagacacaggtaacccagagtggacagtgatttgcgtggggagacacagtggatctggggcctctgatactttgcttcctaaaacagcccccagttttcggcttgccctatgagatgatgttcatgtgcttccttgaaaccaggtggaaagaaaggggaagaattaattttctcattctgttgctgttgaacgtaatgtaatcttaatactgtagccttcctagaagcccttccctctttttcatgctgtaaagtcaaatatttgatatccttaacataaattttaaaaattaaggtcattaggaagcaaatgtctatttccaaagcaatgagcttgttgtgactgtgattttattcttctatagtatttttttcctcattttaactgagaggagaaaataatactcttttgcaatatccttaggttctccccttccccctggtgccccttctagtgtcttaagactttgtcttaacaagtataacattacattttgttgttaaaacctttcgaaactgtattcagtgattcttccaagtttatctgctctgcactatttcactaataaaccctggctaccacgtagcccttgatctccaagtagtttacctatgcaagacctgtgacactctgaattcacttctctttctttcagaaagtagtcataaatggagcttaattataaaggtaaaacttgtctccaaccagtttcattttggccatttctttttcaaaatgtcagctgttttcctccaagatttttcaccaaaacaatgatcataagtgctggaatatataatactttgcaggcataaaataacccagacatactctcatatttctttggtgtattttggttggtaaaacttaccagcattaaatgtaaaatataatgaggagttaattccttacctagaactatttcttccttttaagattcataagtaaccttttatttttacagagctacgtataacttccacattacagtcagggacctgaggtgtaacttactaagtgaaccccaaggttattttatcttgcaaaagaaacctaaaccaaactaagggccttacagtttatggttagactgaatcaaaagctataacctcaatttttccaaaaacagcttctgactgcaaaagcaagtcatacagttgttaggtatgaaatagcactgatcaggaaatgcatcttcgcagatggtatttccttcagaaaagacttttctacttttaatataaattaagccataacagtttcatgctgtggaaagagggtgaaaaggttcattttaagagattatataatatgaactttcacatttactgtgaaatgtctaactttgccagtgcttcagcaagtttttttggggggtgatggggaggggtagtattggttttagaggtttcaaatctgtgaactttggagaggggacagttgttggctctggtatttactagttttgtagtaacgttttgctagcctgactgacttttcttactggtttttatgcccacggtccgaggggactgttcttcttgtttggggtgtctgcggaatagcgtctcgtcttgtttgtataggcagtcaatgtgtgtgacatgtgtgtcctttcagtccggaagcccactgtgtgacaatggcgtggggtgtggctgggaggtggggtgctgaagcttgaagagcatttctttgctgattcataacagtatttcccatcttttgcctgcaggcagggaaagtgtacagtatttattttgtttctgttttactttaaatttgtaagtctttaagtagcttacattgattattataggggaggacaagtgacttgtttaaagttgtatttagtattctttccaatttctgtattttaaaatattgaaattaaaattgtattacttctgttttg

SEQ ID NO: 309284 - DNA, 6845 bp, Homo sapiens
  misc_feature (1291)..(1291): n is a, c, g, or t
  misc_feature (6762)..(6762): n is a, c, g, or t
  misc_feature (6791)..(6791): n is a, c, g, or t
  misc_feature (6815)..(6815): n is a, c, g, or t
  misc_feature (6827)..(6827): n is a, c, g, or t
  misc_feature (6832)..(6832): n is a, c, g, or t
ttcatgaatcctaacagaccaaaagtgttaaatgtgatcagccttgaattttcagatacaaagatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctggggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacagggtggatccatgctgtgctcacttctcaggactgtatggcttttggggggaacttcctgcacaaccttaacattggcatgcagctcaggtgttatgagatggagaaaaggctaaaaacaccagatcttttcaaattccctttctttgaagccatatgttggtttgtagccaaaaacttgctggaaaccctgaaagaactgagagaagatggtttccagcctcaaacttacctagtacagggagtgaaagcactgcatactgctttaaaattatggatgaaaaaagaacttgtatctgaacatgcctttgaaattccagacaatgttagacctggacaccttattaaagaactttctaaagtaattcgagcaatagaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaaagattagagatgtgtccatgggaagaggacatcttgagctctaaactgaatggaaaattcaacaaacatctccaaccatcctccacagtacctgaatggagagcgaaagataatgatctacgattactgctgacaaatggaagaataattaaagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatgggttttttacangtgtgaaatcagaactcaggagtagatcatcaggatattctgatatttctgagtcagaagactccggacccgagtgcactgcactgaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtggataccatgtcaagactgaagatccagacttgaggacttcctcctggattaaacagtttgatacttccagatttcatcctcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaaacgtccaaaaaaaggaatggcaacagccaaacaacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtagaaccttaaaaagagaccttgaactggaaagggtctcttgtcagggcttgaattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattagcttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgtctataaacaacccgtgtaaaccctgtctacactatgccaaaaccagtggaaagatgggtagagtcatcttatctcaggatgtcaaaaatctgggtttgactgattcccctaccttcccacacagtatattcttgtgatttttgcttttctgtagatcctgagtcggtgttacaatagtcatgtttttattttgggttaagaaatacgaggtgtaagagctataatttccttttcgtgttatatcatgatctgggttttcttttttcctttacgtttttcacagctcttgagtattttctatttttttctttagtcacaaaaattaaaattaaactttatttttatgaattaaaatgaaatttaatttatttttatgaattaaaattgtggccagtatccactgtgtccttaggctgagaagtactaatttggagtagcccgtgtgtggaattctaaagtgaaggtactgtggattcatttttagtagttttagccccttaataagtggctaagttagaaaactttcagcgaggtaatagaaccacttgaatagaatccatgtgtctttttctgaattggtgaaaattcggccactgatccagtgactcctggtcaaacgtcttataacattactggccataatgcatccctttatctcatggaaatggctgaactttgtggtagctgctgcgagtacctgggcttaacagtaatagagaacctcatttataccatacagacacagcaacttaggaagacagcactgatagcatttagctagttgtaaccaaatacaaatatgtaaaattgagaattatgattaacatatgcaactttagtaataggaatagatgataattttcctgtattgtttcaaataagtgactgttcagctgggatccattggattataatttacaatgtcacataatattatgcttttcaatattgatgagtgatgtaaacaatataaagttggcagtttgtagtagttcagtatcctagaaatacattgaacttcataagtatcagttcatttttaagcatacagaattgaagattctgactgaaatcataaactcagaggaaacaagcccatctttatcactaattacttagcttgaatacttttctatttttaaataatcctaattattgccttttcaattatagtctactgtatttatttatatgggatcaacaggtatttatcaaacatctactgtgtgcccagcactacctagtactgttggggaacatcaatttgcagttgtggtctctgcccttgaaggtatcttctccaggaaattagcagtattattttcacttctaagcaaacatgagcaaaagaggacctgttcattaaaaaacatgctgacttttttagtttcaactgagatatgccactgtagaagtgaaagtaatttcacaattaaagaaatgcttcaacttggtaattaatatggtcatacagggacttggtgtagcatgcaaggaagcagaagacctgggcttttgtcgaagttctgccatttaggtatcagctgtgtaaccttgaataagtcacttaactctttctcttagttttctcatttgtaaatttggattaaagtgtttattatgataatcaattaagaaaatctcttaacacttcatacatacagagaacttatcattaagttaaaactggcaattaatgcacctttatatatatttttaaatgaaaactaatactattcatgatgtttattttatatcaaatatatgcccagggcatgctactttaaaaatccgaggaatctccaacaaggtgctggattaaaatcagatttcgtgcttgaagtggaagaaaaatgaagttgtttatggataagagagtgagaatgtgtatcctcaagtacgttaagatgatttaactgaaagatggctttaggtttttcttgaagaattaggaaagtaccatccccacagattcagcatactcttcaggtactagataaaggtgaaggaagtcatggaattaaaatgacttagcaactccccagggaacttgtggggagaatgaggtggttagaaaggtgagaatgcacaaagacagctctgggttgggtaccaacagtttgcttggtagaaagaaaccagtgtaggaaaggagacgccaccagacatcttcaacagacaagattctttctgcctttttcaaaagatgctctctgcagcagtaagactatagatagagttgattggaatatcatgtgacccagtatgctactgctaggcataattatcaaaaattcatttttctcattaaatattgttaattgctcgccacataaagagaagctagagctcaccagtcttggtggtgtcctagaccttcctctaaagcagtcttgggaagctggatcatcagatctttagcctagacagagtgtcgctggtaaataaaggagacacaggtaacccagagtggacagtgatttgcgtggggagacacagtggatctggggcctctgatactttgcttcctaaaacagcccccagttttcggcttgccctatgagatgatgttcatgtgcttccttgaaaccaggtggaaagaaaggggaagtatatgcagaattcaaacctgacttcgggggcgtgccagataagtaatggcagtctaagcccagaaaggccaagttggtgaaacttccttcntggtgccccttcaccccaccaagagaccnggcatcaaatccaccacctatcancaaccaggcaanaaaanggttaactgtcca

SEQ ID NO: 309285 - DNA, 2523 bp, Homo sapiens
  misc_feature (1291)..(1291): n is a, c, g, or t
ttcatgaatcctaacagaccaaaagtgttaaatgtgatcagccttgaattttcagatacaaagatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctggggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacagggtggatccatgctgtgctcacttctcaggactgtatggcttttggggggaacttcctgcacaaccttaacattggcatgcagctcaggtgttatgagatggagaaaaggctaaaaacaccagatcttttcaaattccctttctttgaagccatatgttggtttgtagccaaaaacttgctggaaaccctgaaagaactgagagaagatggtttccagcctcaaacttacctagtacagggagtgaaagcactgcatactgctttaaaattatggatgaaaaaagaacttgtatctgaacatgcctttgaaattccagacaatgttagacctggacaccttattaaagaactttctaaagtaattcgagcaatagaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaaagattagagatgtgtccatgggaagaggacatcttgagctctaaactgaatggaaaattcaacaaacatctccaaccatcctccacagtacctgaatggagagcgaaagataatgatctacgattactgctgacaaatggaagaataattaaagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatgggttttttacangtgtgaaatcagaactcaggagtagatcatcaggatattctgatatttctgagtcagaagactccggacccgagtgcactgcactgaaaagtatctttaccactgaagagtctgaaagttcaggtgatgaaaagaaacaagaaataacatccaactttaaggaggaatctaatgtgatgaggaacttccttcaaaagagccagaagccatctagaagtgaaattccaattaaaagggaatgtcctacctcgacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtggataccatgtcaagactgaagatccagacttgaggacttcctcctggattaaacagtttgatacttccagatttcatcctcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaactttcacacatgtatagagaaagtatatttctgactgtatgtgatggtcatcatggcagttgaggtgtagtctctgcactcaagttgttcaacatctcatgcatagtagacagcatagtgatggcagtatacacaggctactacaggaacaaagaaaaaggatacccaagtcagctctgaggagcgagagacagatcctaaaatcagatgttcaggggttagccaggctgaattggggaaagtgacagaatagacagctttgaaggcagaggattgagcctgaggcagggcacaaaggggagaagcaggatatggggtatttgtgaaatggtagtcagttttgttgcctaagcatagtgtaatgcaggatagggaagagcccaggtgaagagcaggcagaccagactgtgggaagccttgtgagtct

SEQ ID NO: 309286 - DNA, 371 bp, Homo sapiens
ctgatcaggtgtgtgaaatatgtcttttgaacctaaaagaatctgataattatccaatttaatttgtatcattgtattgagaaattgcatcaatgtaggctatcctaagtatggcttttgctttttcaaaaatagtatgatacttccttttagggtgagaagattttttatttaataaagccaacagatgaaaatttggcacgttatgaatcttggagttcatctgtgacccagagtgaggtgttctttggagataaggtggataaatgctacaaatgtgtggtaaagcagggacataccttatttgttcctacaggtaaggttttcatcccatcccctactcaacatgattgatagtcacatggagttgg

SEQ ID NO: 309287 - DNA, 771 bp, Homo sapiens
gcagtgagccaggatcgcgccactgcactctagcctaggcgacagagcaagactctgtctcaaaaacaaacaaacatgtgttttaaacttttaagtgttgttgttaaccttaagttccatttaattatttggtttgggaatagatgagaaaaacaattcttaagaatttttaatttgcatgatgtgggtgtgtgtgtatgtttgttttttgaaaggatgtctgaattggtggaggtccctgatatagccaaaaaactttcctgggtggaaaattattggccagatgattcagtctttcccaagccatttgttcagaaatattgcttaatgggagttcaagacagctatacagatttccacattgacttcggtggaacttcagtctggtaccatgtcctctgggtaagattggggtattttttgttctctcactgacaaaaacatatagccctagtttttcagtggtatattcatttcttgtaaatgttacttgtaaagggggaagtttttttttttttttttactttttaaccaggaactgtcactttgcctttaaacgttacgatttttttttttaatctcaaataatggaagagccatgacttttaaatttatattagatttactttctgccctcatcttttaagttggtttcttttaggcttttgtctcttcttgattttttttcccctagttaattatcctttaatccctgaattaaatatctgtgaaggagcaaaattacagtaataattgcttctggccttaatg

SEQ ID NO: 309288 - DNA, 333 bp, Homo sapiens
ggctgcctgtatctttgagatgcaggaccatgggggaggtggtggtatactgtattccatcagtcgaacagggctacctgagggtggatggtaagtaagttctgcatttataccttcaggacatcttgagctctaaactgaatggaaaattcaacaaacatctccaaccatcctccacagtacctgaatggagagcgaaagataatgatctacgattactgctgacaaatggaagaataattaagtatgtaaagtaaatcagagtatcaaatagattaattttcattgggttccctttgttcatttaacccagtggtcctcaacctttctggc

SEQ ID NO: 309289 - DNA, 184 bp, Homo sapiens
gcagtaaccatgaggttaggcagttgtatcgctatgataaaccagtggaatgtggtaagaaacataaattatcagtctctaaaaagtaacatatgttgcccaacttaatggctcaataatcctcatttaggttagagattatgaataagcatctttaattggaaatgtgttaagaaggttgacc

SEQ ID NO: 309290 - DNA, 555 bp, Homo sapiens
cccgggctcgcaggaattcggcacgaggcgataatccacgtttgtgcataggcgtgtgtggggatgcatatgtctgttttctttttaatatacatttaaaatacagtattatcactttataaaacatacattaagcctaataaatggaccaataagccaaactatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaataaaaaaaaaagcatggagt

SEQ ID NO: 309291 - DNA, 2149 bp, Homo sapiens
agcggagggggagatccgctcctctgcgtgcgatccccggcgcccgcgcgcgcccacagcgctccgccagagctgccgccgcggactcgccgggagtgggggtctccgctggtgccagcccgcttctggagaccctccgcctcctgccaacccctgctcttccaggtcgggccccggggttctgcggctgttagggacagaggcaaagaagggcaggacggtccggtttcccgtggatgttcccgcccgagaaagacagcaagttgtgtgtgcgcccgggacgcgggagggaaggtagccgccgcccgccagccatggaccatcatctttagtgcagaggatggaaagttgatgcccagtaagactgaagatccattctgcattacggaactgtggattatctgtgggtccctggtgatttcacaccttcattcactcctgcagtccctgaacacttacttggggtcctcattgccctatctggtgaaagatggcatccagcctgacttgtactggagtaatctgggctttgctgtcttttctttgtgctgccacctcctgcgtggggttctttatgccttactggctctggggatcacagctgggcaagcctgtgtccttcggtaccttccggaggtgctcatatcctgtgcatgatgagagtcggcagatgatggtgatggtggaggaatgtgggcgctatgcctccttccagggcatccccagcgcagaatggaggatctgcaccatagtgaccggcctgggttgtggcctcctcctcctggtggcgctcactgccctcatgggttgctgtgtttccgacctcatctccaggacagtgggaagagtggctggaggaattcagtttcttgggggcttgttgattggtgctggctgtgccctctaccccttgggctgggacagtgaggaagtccggcagacttgtggctacacttctggccagtttgacctggggaagtgtgaaatcggctgggcctactactgcacgggagcaggtgccactgccgccatgctgctgtgcacgtggctggcttgcttttcgggcaagaaacagaagcactacccatactgagatggagctaccaagagcagacagaggagaagatgggccaaaggggcttggagaggtcaaaacatccacctaccttcaaaaggtgggatagtagttctaatccaatacaatgctaataaaatgaaacccgataaaatcaggaacatgatataggaaggaaggattgtaggagatttgtgggggaaaaaaaaggagagtatagaatgatggagaaaaatggaccaaaggctaaaaatattgcagggcatcgggtgtttctattccacagagtattgttaatgtacaacacacacacacacacacacacacacacacacacacacacaacaaatctacatatacaaacaagggtttgggttttagttttttttttttaaggtgaggactcagaaaatcaaagggctagtagaaacagtgttatgttgggaagcagggtacccccaaagatgttccctgtaggtcacggcactcccaaaagcacacaagcacatacagacatatgcatccccacacacgcctatgcacaaacgtggattatcgcacagactgggaggtttagtggtgcatttctcctctgttttctttttaatatacatttaaaatacagtattatcactttataaaacatacattaagcctaataaatggaccaataagccaaactatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaataaaaaaaaaagcatggagt

SEQ ID NO: 309292 - DNA, 414 bp, Homo sapiens
acagttcatttctgacagagaaggtgtggttgcaagggaatgaagcggctgctcatattgcaaccacagtctggaaacagaaagagatggatgctgatgttagcaagccccaccacacaacacacacacacacacacacacacacacacacacacacacaacaaatctacatatacaaacaagggtttgggttttagttttttttttttaaggtgaggactcagaaaatcaaagggctagtagaaacagtgttatgttgggcccagggttctatttattgccttgctctgccctctcccttccccggttgtgggacaagagccctccctgaacccctgcaaccctccctgaacccctgcaaatgaaaccaaacgtccacctgggtgtgttcattccttccgtgtccttcaaagt

SEQ ID NO: 309293 - DNA, 1910 bp, Homo sapiens
gaggtgactctagcggatcttattcacagactgcgccgggacgcgggagtaaaggtagccgccgcccagccagccatggaccatcatctttagtgcagaggatggaaagttgatgcccagtaagactgaagatccattctgcattacggaactgtggattatctgtgggtccctggtgatttcacaccttcattcactcctgcagtccctgaacacttacttggggtcctcattgccctatctggtgaaagatggcatccagcctgacttgtactggagtaatctgggctttgctgtcttttctttgtgctgccacctcctgcgtggggttctttatgccttactggctctggggatcacagctgggcaagcctgtgtccttcggtaccttccggaggtgctcatatcctgtgcatgatgagagtcggcagatgatggtgatggtggaggaatgtgggcgctatgcctccttccagggcatccccagcgcagaatggaggatctgcaccatagtgaccggcctgggttgtggcctcctcctcctggtggcgctcactgccctcatgggttgctgtgtttccgacctcatctccaggacagtgggaagagtggctggaggaattcagtttcttgggggcttgttgattggtgctggctgtgccctctaccccttgggctgggacagtgaggaagtccggcagacttgtggctacacttctggccagtttgacctggggaagtgtgaaatcggctgggcctactactgcacgggagcaggtgccactgccgccatgctgctgtgcacgtggctggcttgcttttcgggcaagaaacagaagcactacccatactgagatggagctaccaagagcagacagaggagaagatgggccaaaggggcttggagaggtcaaaacatccacctaccttcaaaaggtgggatagtagttctaatccaatacaatgctaataaaatgaaacccgataaaatcaggaacatgatataggaaggaaggattgtaggagatttgtgggggaaaaaaaaggagagtatagaatgatggagaaaaatggaccaaaggctaaaaatattgcagggcatcgggtgtttctattccacagagtattgttaatgtacaacacacacacacacacacacacacacacacacacacacacaacaaatctacatatacaaacaagggtttgggttttagttttttttttttaaggtgaggactcagaaaatcaaagggctagtagaaacagtgttatgttgggaagcagggtacccccaaagatgttccctgtaggtcacggcactcccaaaagcacacaagcacatacagacatatgcatccccacacacgcctatgcacaaacgtggattatcgcacagactgggaggtttagtggtgcatttctcctctgttttctttttaatatacatttaaaatacagtattatcactttataaaacatacattaagcctaataaatggaccaataagccaaactatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaataaaaaaaaaagcatggagt

SEQ ID NO: 309294 - DNA, 2202 bp, Homo sapiens
tcctcggggtcacccaggaagacaagcaactttctcccatacttctcggtctgtctgccttccccactcagctttgaatgagacgcagggagagggggcgcgagggggctcggggctaggggaggagccgcgaaagctgcccccgggggtgggcctggacccgcgcggacagcggggcacccccccactcccttcccggcgctccaggaacgtccccggtcgggccccggggttctgcggctgttagggacagaggcaaagaagggcaggacggtccggtttcccgtggatgttcccgcccgagaaagacagcaagttgtgtgtgcgcccgggacgcgggagggaaggtagccgccgcccgccagccatggaccatcatctttagtgcagaggatggaaagttgatgcccagtaagactgaagatccattctgcattacggaactgtggattatctgtgggtccctggtgatttcacaccttcattcactcctgcagtccctgaacacttacttggggtcctcattgccctatctggtgaaagatggcatccagcctgacttgtactggagtaatctgggctttgctgtcttttctttgtgctgccacctcctgcgtggggttctttatgccttactggctctggggatcacagctgggcaagcctgtgtccttcggtaccttccggaggtgctcatatcctgtgcatgatgagagtcggcagatgatggtgatggtggaggaatgtgggcgctatgcctccttccagggcatccccagcgcagaatggaggatctgcaccatagtgaccggcctgggttgtggcctcctcctcctggtggcgctcactgccctcatgggttgctgtgtttccgacctcatctccaggacagtgggaagagtggctggaggaattcagtttcttgggggcttgttgattggtgctggctgtgccctctaccccttgggctgggacagtgaggaagtccggcagacttgtggctacacttctggccagtttgacctggggaagtgtgaaatcggctgggcctactactgcacgggagcaggtgccactgccgccatgctgctgtgcacgtggctggcttgcttttcgggcaagaaacagaagcactacccatactgagatggagctaccaagagcagacagaggagaagatgggccaaaggggcttggagaggtcaaaacatccacctaccttcaaaaggtgggatagtagttctaatccaatacaatgctaataaaatgaaacccgataaaatcaggaacatgatataggaaggaaggattgtaggagatttgtgggggaaaaaaaaggagagtatagaatgatggagaaaaatggaccaaaggctaaaaatattgcagggcatcgggtgtttctattccacagagtattgttaatgtacaacacacacacacacacacacacacacacacacacacacacaacaaatctacatatacaaacaagggtttgggttttagttttttttttttaaggtgaggactcagaaaatcaaagggctagtagaaacagtgttatgttgggaagcagggtacccccaaagatgttccctgtaggtcacggcactcccaaaagcacacaagcacatacagacatatgcatccccacacacgcctatgcacaaacgtggattatcgcacagactgggaggtttagtggtgcatttctcctctgttttctttttaatatacatttaaaatacagtattatcactttataaaacatacattaagcctaataaatggaccaataagccaaactatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaataaaaaaaaaagcatggagt

SEQ ID NO: 309295 - DNA, 439 bp, Homo sapiens
  misc_feature (17)..(17): n is a, c, g, or t
ggaagaatcgagccggncccctagttttagaagtttcaatagcaagtatcagtattttgtatatcctgcataaactctaatttagttcctcaacatattttcagtgtttatgcagacctttagagttaagcctttgtatttccatgttattccacaatatgcaatatttctctgagtagcttctgctatgatattcttatgaagaaaaggggcaactttctgtccactataggagagaattcagccgaagatatgagagtaatgagagacattttccagtcattggatcgtgttttcttttgtccattattgtactgtgctgtaccacatttatttctatattcattttgtaaaaaatttaaaagtgctattttgtttgtatttgaaaatctctgtgaataaattctctctttgatcaataaaaaaaaaagcatggagt

SEQ ID NO: 309296 - DNA, 402 bp, Homo sapiens
gctcctgccctcagaaatctcctgctggggctcttctcaccctctccagcctgctctgtctgacccaggctaactgacgattcaaggccacatgtggctcttgggactggtgggacctttggtgacccaaagtgagcagactcccttcagagcattcaatttcaaaaagaaagagaagggctggtactagacaaaccccttctcctgctgagacccatgcatgcggctgccagtcactgtgagcagctcactgtgagccgcccctggccccctcccacctaacagatccactagcaaggagtggactttctgaccccagggccctgcacacgccattcccttggtttgtgggtgaagaaactgagatcaatatggaaaaccagtaccaggactcaaactccc

SEQ ID NO: 309297 - DNA, 685 bp, Homo sapiens
tgtcgagtttatactcatttagctgcaatgtgggacaatgaaaaatgctttacaggcctggagtatcattacttatggtatctcctgctttaaaatctcaagcgatatctatctggttaaattccattttaggagattgagatgcagaacgttaatgttcattacctcctcctaccccaagagaaatggattcagacatgtcttgtctcaacaagaaattgatttttttttaaactatctcattctgttgccaaatatcacagaagtaatgaggagtttagttacatttggctgttgtgctctgaaagagccaggtttggaatttgtgggggtgatctaggaagaaggttccaaagaagcagaggcatttgtcaagttacctaccctatatccagcatcctcctcatgagcttcagtagctgctctttgcccacgcctgtatcctacgtttgctatttgggcaaaccattacttcagttatttaacttccctttttttttaacttcacctttgactatgaacaagtaacggtaacattccttttgtgtattcaataatgcagttagtttacctttttcagaatattttgaacaaagatctttgtctctttctgctggaatgcgcacacagtgaacgtttgttagaactacacacaataaagacactgttttccttttattgcccc

SEQ ID NO: 309298 - DNA, 491 bp, Homo sapiens
tgagcctgtaaagttgttttagcagttgtcataaatgcatatgttgtgaaatcagaacactgtcgagtttatactcatttagctgcaatgtgggacaatgaaaaatgctttacaggcctggagtatcattacttatggtatctcctgctttaaaatctcaagcgatatctatctggttaaattccattttaggagattgagatgcagaacgttaatgttcattacctcctcctaccccaagagaaatggattcagacatgtcttgtctcaacaagaaattgatttttttttaaactatctcattctgttgccaaatatcacagaagtaatgaggagtttagttacatttggctgttgtgctctgaaagagccaggtttggaatttgtgggggtgatctaggaagaaggttccaaagaagcagaggcatttgtcaagttacctaccctatatccagcatcctcctcatgagcttcagtagctgctctttgcc

SEQ ID NO: 309299 - DNA, 211 bp, Homo sapiens
  misc_feature (41)..(41): n is a, c, g, or t
cctcggtcaaggtgaggtgtgcgaggcgaaggatgtggcangccaccggaagatggcgtggtctggagtctccttcgcctccgcacacctcaccttgaccgagccctaccgcggaggctgccaagcccaggactacaccggcggcatgggcatcgtcaacggggccaagtggaacccccggaccgggagtgagtcagcctgggaggggctg

SEQ ID NO: 309300 - DNA, 4087 bp, Homo sapiens
tggagacggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309301 - DNA, 4109 bp, Homo sapiens
agcggccgctcgcgatctagaaccggacgcgtgggtcgaacccacgcgtccgacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309302 - DNA, 4190 bp, Homo sapiens
tggagacggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatggtgggcaccatgcccaggctcttggctctgctcccattgtctgggcgaggggtgggctctcagaggggctggcagtactgctctgaggcctgcctctccccagacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309303 - DNA, 3077 bp, Homo sapiens
  misc_feature (34)..(34): n is a, c, g, or t
  misc_feature (75)..(75): n is a, c, g, or t
  misc_feature (79)..(79): n is a, c, g, or t
  misc_feature (103)..(103): n is a, c, g, or t
gaggagggaggtcaaggaagaacattcccaggantcctaagaagtggggcagatggcagggctgaggatgggttntgcntccccaaagccatcccttccctanttcccaaatgaagggacggcagtgggaccaggtctgtggaaaagtggtgcatggtcagaatgggtgcagtttgaggggcctgtgcggaggccctcagggagatgttggactgtgcctgggtccccaaccacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309304 - DNA, 3272 bp, Homo sapiens
gtgggggccacaggatgggggtgctgggacaagtgactggcccaatgtcacaaacaggacccaggtccccggaaccctttcctactcagattcttgggacccagaagggaggggccccgggagcccaggatagcctcgcttggctgccccagccctggaccccaggctggcctgcttcaggagggtggcagctccccagggcccctagtggctgggcgtggtagggggaggacctggggccttggtggggagtgaggacctcaggtaccttcacaggtatccctgcagggccattgtgcagacggtccccatctggatgacatctgtggctgcgccctgggggagctctacctgtgatttcacgtgtgtcccctgagagctgggcatggtcagcccgttctccagatggggcagctgaggcccagggaggggaagcacaggctgggattggaaacagctcctggcctggctttgagtcgattccaggtgggctggtgcagggcaccagggagccaccagctgaccagagctgccctctgactgtgcccccgatgtgccgggagtgggctctgggctccttggttctgggtttggtggagggaaggatggagctagtgagccaccattctggggtacgcgtcctcagagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309305 - DNA, 4127 bp, Homo sapiens
tggagacggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggcaaaaaaaaaaatgaataaaaatataataaaaaaaagggggg

SEQ ID NO: 309306 - DNA, 2673 bp, Homo sapiens
tactgctacctagtggggtactgctacctagtggacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309307 - DNA, 2658 bp, Homo sapiens
cggacacacgcacatcatatagtcgtcctcagagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309308 - DNA, 2516 bp, Homo sapiens
gggaagacccttgctctgaccactgtccactccacagtgacgattttgtgaccaccttcttcgtgggcttcagcaatgacagccagacatgggtgatgtacaccaacggctatgaggaaatggtgggcaccatgcccaggctcttggctctgctcccattgtctgggcgaggggtgggctctcagaggggctggcagtactgctctgaggcctgcctctccccagacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309309 - DNA, 1538 bp, Homo sapiens
acgacatctagaggatacccgcacgaggcagaggtgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309310 - DNA, 4102 bp, Homo sapiens
  misc_feature (3943)..(3943): n is a, c, g, or t
  misc_feature (3977)..(3977): n is a, c, g, or t
  misc_feature (3987)..(3988): n is a, c, g, or t
  misc_feature (4018)..(4018): n is a, c, g, or t
  misc_feature (4032)..(4032): n is a, c, g, or t
  misc_feature (4034)..(4034): n is a, c, g, or t
  misc_feature (4037)..(4037): n is a, c, g, or t
  misc_feature (4039)..(4039): n is a, c, g, or t
  misc_feature (4041)..(4041): n is a, c, g, or t
  misc_feature (4102)..(4102): n is a, c, g, or t
tggagacggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatgggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgaggcgcgcgntagacacacacacacatagaaacatagagcgcancacactcacnnagacagagcacacgcacgcgacatagatanatacagacagagcntncancntnacatacacacacacatagacacacagatacatacagatacacagacagacatagagagagn

SEQ ID NO: 309311 - DNA, 1251 bp, Homo sapiens
  misc_feature (22)..(22): n is a, c, g, or t
  misc_feature (29)..(29): n is a, c, g, or t
  misc_feature (36)..(37): n is a, c, g, or t
tcgctgggcactcgtcacggcncaagtgnaaccccnngacgggactatcaatgacttcagttacctgcataccaactgcctggagctctccttctacctgggctgtgacaagttccctcatgagagtgagctgccccgcgagtgggagaacaacaaggaggcgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309312 - DNA, 1226 bp, Homo sapiens
ggcagtgccggacaggatgtgcagacacaactacgagctggacgaggccgtgaccctgcagcgccgagtccagcctaaggtgaacgtttccccctccaagaaggggccccagcagcaccaccaggactcctggtggtgctgctcaccttcatggagcaggtgcaccgcggcattaagggggtggtgacggacgagcaaggcatccccattgccaacgccaccatctctgtgagtggcattaatcacggcgtgaagacagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309313 - DNA, 2656 bp, Homo sapiens
tggagacggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309314 - DNA, 465 bp, Homo sapiens
tgatgatagcaagaggacaggagtattggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309315 - DNA, 511 bp, Homo sapiens
aaagctggtggcctatgtgatttgctgggttaccgagctcgatgttcgtcatcagtgggacgacgcgctgtgccgtgctgtgatagatagacatactggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggca

SEQ ID NO: 309316 - DNA, 2228 bp, Homo sapiens
tggagacggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccctgtctacagctactacgcacagaatgaggtggtggccaccgatgacctggatttccggcaccacagctacaaggacatgcgccagctcatgaaggtggtgaacgaggagtgccccaccatcacccgcacttacagcctgggcaagagctcacgaggcctcaagatctatgccatggagatctcagacaaccctggggagcatgaactgggggcggccgagatatacgatacacctgcttagtatctcatttccaccgatgttctcgcctcccagttatatctgttt

SEQ ID NO: 309317 - DNA, 1965 bp, Homo sapiens
tggagacggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggggcgcccctctcaaataactggcagaatccaggagaggagacccatgtggaggcacgggagcaccagcctgagccggaggaggagaccgagcaacccacactggactacaatgaccagatcgagagggaggactatgaggactttgagtacattcggcgccagaagcaacccaggccacccccaagcagaaggaggaggcccgagcgggtctggccagagccccctgaggagaaggccccggccccagccccggaggagaggattgagcctcctgtgaagcctctgctgcccccgctgccccctgactatggtgatggttacgtgatccccaactacgatgacatggactattactttgggcctcctccgccccagaagcccgatgctgagcgccagacggacgaagagaaggaggagctgaagaaacccaaaaaggaggacagcagccccaaggaggagaccgacaagtgggcagtggagaagggcaaggaccacaaagagccccgaaagggcgaggagttggaggaggagtggacgcctacggagaaagtcaagtgtccccccattgggatggagtcacaccgtattgaggacaaccagatccgagcctcctccatgctgcgccacggcctgggggcacagcgcggccggctcaacatgcagaccggtgccactgaggacgactactatgatggtgcgtggtgtgccgaggacgatgccaggacccagtggatagaggtggacaccaggaggactacccggttcacaggcgtcatcacccagggcagagactccagcatccatgacgattttgtgaccaccttcttcgtgggcttcagcaatgacagccagacatgggtgatgtacaccaacggctatgaggaaatgacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccgtgagtgtggagggctggcagggg

SEQ ID NO: 309318 - DNA, 3134 bp, Homo sapiens
  misc_feature (70)..(70): n is a, c, g, or t
  misc_feature (198)..(198): n is a, c, g, or t
  misc_feature (230)..(230): n is a, c, g, or t
  misc_feature (1009)..(1009): n is a, c, g, or t
  misc_feature (1630)..(1630): n is a, c, g, or t
aacaaacaggtctgttcttattaccattttccaatctgtcacttcatgtcccatgtcccacatgggcagncaacatggcctgcccatgtggcggcacctccccaggccttccacctcgtgctcctctgcagccccttgcctgtccctgccatcttgccatgcccacgcctgcattgctaagaacacagtttacagccngtgttttttgtgctgccattctgctggcatanggccaggactggaaagcttgattcagtattagaccatcatatatggacaataagtgcttaatttgttctaggcactgtgttaagggggcagaagcaaccatgagtaacatggattcaggccctgccaggttcttcttgtcctaagggaaccacagacacacagctgagtgcgattcagatcatgggcaccacaatgccctatccagaggtgggggacactcagtgctgcatctctctctgcggagtggctctgtgaccatggccaggcttcctgctgcagagcagccctgcacggcctcccccactgtccggggtctttctgtatctccacccccccattttttttttttttttttggagatggagtcacactttgtcgccaggctggagtgcagtggcgtgatctcggctcactgcagcctccacctcccaggtttcaagcaattcacctgcctcagcctcctgagtagctggaactacaggcacacaccaccatacccagctaatttttgtatttttagcagagacgggatttcaccatgttggccaggatggtctcgatctcttgacctcttgatccacctgcctcggcctcccaaagtgctgggattacaggcgtgagccaccacgcccagccatctccacccctttcttctctgctgtctgggtaactgtggactcctttccggagctccccgttctacattttcagtttcctcctgcctggttgccctcctcgttgaccttcagagtgctcagcctttcttcttctgctgaanccctttttgtggcctttgcctgtttttgcccttgtcccacagccagcctcaacggtgttcttttctctctgctcaccctccctgtttgcctacagctctgcggagctgtcctgaaaggtgaagggggcgccttcatcagagcctcaccgccccgcgccactgggctgcatctcttcggtaccctcctgcctattctgtctcccccatctgagtgcctccagctctgcacccacagccgcccccagcctgacctgctgatgccgtatgtcccagtttgaaagcttcctcgaatgcctgcagacaggagcaaaaccctggagagcctggcccccatctgtgggtccatccccccatctccacctacccttgcgtgctgctgccatgggcccatctttccccaggcttctgctctggctgtcccatctgccaggaatgccttttctctcccagggctctccacctgcccaaagtctggaacagctagccatgccaccacctcatctttcgggtggaaggaggctttctcctgtggccctcatccattttacctgccctctcccgtggtggccaccagtccctgtgttcttcccacaagcagtttgagctacctgtcctggaccngtgtggctccatgggcccctgttttgtctcctttctttcttctacgagtcagatctctaagggccagtcctccgctgctatagccagcatggggcattgtaaacagtaggcgtgtaatatatgactcttcggcagctgcaccctctccctggggacaggtttcctagtcccagagttagcctggaggtgagctgaggttaaagccaggttccctgactcccacagttcttccccttaaatgtttctagttttaggttcatcctgaactcaccagtccaaccacaaaagttttctgaggagaagcagaatttaagtctctttcaggcccatcatcaaaattcccatatgtccttgacataaggctaaatagtctatggtgtggcttgtgctaggcttttgccatcaggtacctgcagggcacacagccacctgcactcattctgagggtctcctgcagcatatcgcaggttctcagcagtacagaggcgaagtgtcccagcacagtccagcacggagtggggatgggagtctttggtggctttgttttaggatgacatgcacttacctctcctttacttccctcccaggagatggctggccgagctctcaagcagactggcagcaggagcatcgaggccgccctggagtacatcagcaagatgggctacctggacccgaggaatgagcagattgtgcgggtcattaagcagacctccccaggtgagcccaggcctgcagcatagtgggcaaagatggtttgtggcttaaggacaacaaaaccacgtgcagaggggtccaacctggcctggcctggccagagccagtctcctggcacattgcctcattcagttaacaggcaagctgagcctgccctgccctgacagagtcaggccctggcgggagcagccccaagtggtagaccgtgggacacgcctggcgcttgccccatccagccttgtctgaaattaccttagtacttcctacctaggggaaggtgtgtgcttgttttatgaaagatcaaaaaagtcagcaaagcgggcgtaaaaatggtcttttcactttctcttgggcctgtggagggatctttgacaagggtggcttctttcctcaattctaaacacacctctctcacatcgtagcttctgagagtgggggttcaatggcaggcagtgtgggcagagcgctgggcccccctcagcatcccctgtgatgggcctgaggcaccgcaccaaacccctgctttttactggctatggatgaatgttactttcccaagatggagcacatgggccctgtgattggtacctgaggcccctggggtgtgataaaggattcatggccaggcgcagtggctcaagcctgtaacccaacactgtgtggcctggttttgttttgctttgttttgttttgtgtaatcccaactctttgggaggctgaggccagaggatggaggcaggagttggagaccagcctgggcaacagagggagacctcgtctgtattta

SEQ ID NO: 309319 - DNA, 606 bp, Homo sapiens
gaaatcctaagaccttgctgtgttattgaccatcaatctcagacactgtctgggctctccggcagcgtggagagtcctggccccgcctcgagaacagaggccaaggacgggaagtgcaggggtccgtgtacttgcagttgggttctattctacccacacggtgtcttacaagttttttaaaaatgtctttccaacttttaagaaccaagagctttcacactgaaaattgggcctggagagggggcgagcgcctgtggtcccagtgtgtcaggagactgaggcaggaggatgggacgtagtgagaccctatctctaaaaagaaaaaaaaaaaggaattaagaaaattgggtttttagcattcctagaaatgtagaagccctgagctgcgtctcctgtgtgggagctggtcccactccccggccttcggagccctcggagcccggagccctcgatgcagcgctatggatgccgggagcgatctttggaaaggagtccccggctcgagcgacactgcccccctggggctctgcaggtgcatgcagtgggattgctgggctggactagagggtgagggtggcttcccccacaccccctttcctggctaat

SEQ ID NO: 309320 - DNA, 5501 bp, Homo sapiens
gtctgcgctttggaaccgcggcgtgagcgccccgggaagatggagcagtcgccgtccacgccaccgccgccgcccggggctcccccgtccctgcggggccagcagcagctccagccaccagtgcccggtctcccggcgcgagaggcccgggagccgccggccaggacgcccccgagggtgtagaccgcgcccctggagagagtgataatcttcaaaatgaagactttggaaaattttaggttctctataggaactacaaaaatggaaggaaagaacattttcaaaaggaaattattttgaaagtatgtttacaacaaactgatactattgacagtttttttttttaaataataaaacactttaagaagattgtatttatggtaaaaggaaactggactaacaatgaggccaaagacttttcctgccacgacttattctggaaatagccggcagcgactgcaagagattcgtgaggggttaaaacagccatccaagtcttcggttcaggggctacccgcaggaccaaacagtgacacttccctggatgccaaagtcctggggagcaaagatgccaccaggcagcagcagcagatgagagccaccccaaagttcggaccttatcagaaagccttgagggaaatcagatattccttgttgccttttgctaatgaatcgggcacctctgcagctgcagaagtgaaccggcaaatgctgcaggaactggtgaacgcaggatgcgaccaggagatggctggccgagctctcaagcagactggcagcaggagcatcgaggccgccctggagtacatcagcaagatgggctacctggacccgaggaatgagcagattgtgcgggtcattaagcagacctccccaggaaaggggctcatgccaaccccagtgacgcggaggcccagcttcgaaggaaccggcgattcgtttgcgtcctaccaccagctgagcggtaccccctacgagggcccaagcttcggcgctgacggccccacggcgctggaggagatgccgcggccgtacgtggactaccttttccccggagtcggcccccacgggcccggccaccagcaccagcacccacccaagggctacggtgccagcgtagaggcagcaggggcacacttcccgctgcagggcgcgcactacgggcggccgcacctgctggtgcctggggaacccctgggctacggagtgcagcgcagcccctccttccagagcaagacgccgccggagaccgggggttacgccagcctgcccacgaagggccagggaggaccgccaggcgccggcctcgctttcccaccccctgccgccgggctctacgtgccgcacccacaccacaagcaggccggtcccgcggcccaccagctgcatgtgctgggctcccgcagccaggtgttcgccagcgacagccccccgcagagcctgctcactccctcgcggaacagcctcaacgtggacctgtatgaattgagcagcacctccgtccagcagtggccggctgccaccctggcccgccgggactccctgcagaagccgggcctggaggcgccgccgcgcgcgcacgtggccttccggcctgactgcccagtgcccagcaggaccaactccttcaacagccaccagccgcggcccggtccgcctggcaaggccgagccctccctgcccgcccccaacaccgtgacggctgtcacggccgcgcacatcttgcacccggtgaagagcgtgcgtgtgctgaggccggagccgcagacggctgtggggccctcgcaccccgcctgggtgcccgcgcctgccccggcccccgcccccgcccccgccccggctgcggagggcttggacgccaaggaggagcatgccctggcgctgggcggcgcaggcgccttcccgctggacgtggagtacggaggcccagaccggaggtgcccgcctccgccctacccgaagcacctgctgctgcgcagcaagtcggagcagtacgacctggacagcctgtgcgcaggcatggagcagagcctccgtgcgggccccaacgagcccgagggcggcgacaagagccgcaaaagcgccaagggggacaaaggcggaaaggataaaaagcagattcagacctctcccgttcccgtccgcaaaaacagcagagacgaagagaagagagagtcacgcatcaagagctactcgccatacgcctttaagttcttcatggagcagcacgtggagaatgtcatcaaaacctaccagcagaaggttaaccggaggctgcagctggagcaagaaatggccaaagctggactctgtgaagctgagcaggagcagatgcggaagatcctctaccagaaagagtctaattacaacaggttaaagagggccaagatggacaagtctatgtttgtcaagatcaaaaccctggggatcggtgcctttggagaagtgtgccttgcttgtaaggtggacactcacgccctgtacgccatgaagaccctaaggaaaaaggatgtcctgaaccggaatcaggtggcccacgtcaaggccgagagggacatcctggccgaggcagacaatgagtgggtggtcaaactctactactccttccaagacaaagacagcctgtactttgtgatggactacatccctggtggggacatgatgagcctgctgatccggatggaggtcttccctgagcacctggcccggttctacatcgcagagctgactttggccattgagagtgtccacaagatgggcttcatccaccgagacatcaagcctgataacattttgatagatctggatggtcacattaaactcacagatttcggcctctgcactgggttcaggtggactcacaattccaaatattaccagaaagggagccatgtcagacaggacagcatggagcccagcgacctctgggatgatgtgtctaactgtcggtgtggggacaggctgaagaccctagagcagagggcgcggaagcagcaccagaggtgcctggcacattcactggtggggactccaaactacatcgcacccgaggtgctcctccgcaaagggtacactcaactctgtgactggtggagtgttggagtgattctcttcgagatgctggtggggcagccgccctttttggcacctactcccacagaaacccagctgaaggtgatcaactgggagaacacgctccacattccagcccaggtgaagctgagccctgaggccagggacctcatcaccaagctgtgctgctccgcagaccaccgcctggggcggaatggggccgatgacctgaaggcccaccccttcttcagcgccattgacttctccagtgacatccggaagcagccagccccctacgttcccaccatcagccaccccatggacacctcgaatttcgaccccgtagatgaagaaagcccttggaacgatgccagcgaaggtagcaccaaggcctgggacacactcacctcgcccaataacaagcatcctgagcacgcattttacgaattcaccttccgaaggttctttgatgacaatggctacccctttcgatgcccaaagccttcaggagcagaagcttcacaggctgagagctcagatttagaaagctctgatctggtggatcagactgaaggctgccagcctgtgtacgtgtagatgggggccaggcacccccaccactcgctgcctcccaggtcagggtcccggagccggtgccctcacaggccaatagggaagccgagggctgttttgttttaaattagtccgtcgattacttcacttgaaattctgctcttcaccaagaaaacccaaacaggacacttttgaaaacaggactcagcatcgctttcaataggcttttcaggaccttcactgcattaaaacaatatttttgaaaatttagtacagtttagaaagagcacttattttgtttatatccattttttcttactaaattatagggattaactttgacaaatcatgctgctgttattttctacatttgtattttatccatagcacttattcacatttaggaaaagacataaaaactgaagaacattgatgagaaatctctgtgcaataatgtaaaaaaaaaaaaagataacactctgctcaatgtcacggagaccattttatccacacaatggtttttgttttttattttttcccatgtttcaaaattgtgatataatgatataatgttaaaagctgctttttttggctttttgcatatctagtataataggaagtgtgagcaaggtgatgatgtggctgtgatttccgacgtctggtgtgtggagagtactgcatgagcagagttcttctattataaaattaccatatcttgccattcacagcaggtcctgtgaatacgtttttactgagtgtctttaaatgaggtgttctagacagtgtgctgataatgtattgtgcgggtgacctcttcgctatgattgtatctcttactgttttgttaaagaaatgcagatgtgtaactgagaagtgatttgtgtgtgtgtcttggttgtgattggattctttggggggggggaactgaaacatttgtcatatactgaacttatatacatcaaaagggattaatacagcgatgccaaaaagtttaatcacggacacacgtccgtttctgtagtccgtatgctctttcattcttggtagagctggtatgtggaatgccatacctctgaccctactacttacctttttactgacagactgcccacactgaaagcttcagtgaatgttcttagtcctgttttcttctgttactgtcaggaaactgagtgatctaatggttctctcactttttttttgttcttttagtgtactttgaagtatcaaatcttaacttggtttaaacaatacatattcctaacctttgtaaaaaagcaaagattcttcaaaatgacattgaaataaaaagtaagccatacgtattttcttagaagtatagatgtatgtgcgtgtatacacacacacacacacacagagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagcttctactggcacaatttattattaaaattttgaatccaaa

SEQ ID NO: 309321 - DNA, 5723 bp, Homo sapiens
  misc_feature (5707)..(5707): n is a, c, g, or t
gtctgcgctttggaaccgcggcgtgagcgccccgggaagatggagcagtcgccgtccacgccaccgccgccgcccggggctcccccgtccctgcggggccagcagcagctccagccaccagtgcccggtctcccggcgcgagaggcccgggagccgccggccaggacgcccccgagggtgtagaccgcgcccctggagagagtgataatcttcaaaatgaagactttggaaaattttaggttctctataggaactacaaaaatggaaggaaagaacattttcaaaaggaaattattttgaaagtatgtttacaacaaactgatactattgacagtttttttttttaaataataaaacactttaagaagattgtatttatggtaaaaggaaactggactaacaatgaggccaaagacttttcctgccacgacttattctggaaatagccggcagcgactgcaagagattcgtgaggggttaaaacagccatccaagtcttcggttcaggggctacccgcaggaccaaacagtgacacttccctggatgccaaagtcctggggagcaaagatgccaccaggcagcagcagcagatgagagccaccccaaagttcggaccttatcagaaagccttgagggaaatcagatattccttgttgccttttgctaatgaatcgggcacctctgcagctgcagaagtgaaccggcaaatgctgcaggaactggtgaacgcaggatgcgaccaggagatggctggccgagctctcaagcagactggcagcaggagcatcgaggccgccctggagtacatcagcaagatgggctacctggacccgaggaatgagcagattgtgcgggtcattaagcagacctccccaggaaaggggctcatgccaaccccagtgacgcggaggcccagcttcgaaggaaccggcgattcgtttgcgtcctaccaccagctgagcggtaccccctacgagggcccaagcttcggcgctgacggccccacggcgctggaggagatgccgcggccgtacgtggactaccttttccccggagtcggcccccacgggcccggccaccagcaccagcacccacccaagggctacggtgccagcgtagaggcagcaggggcacacttcccgctgcagggcgcgcactacgggcggccgcacctgctggtgcctggggaacccctgggctacggagtgcagcgcagcccctccttccagagcaagacgccgccggagaccgggggttacgccagcctgcccacgaagggccagggaggaccgccaggcgccggcctcgctttcccaccccctgccgccgggctctacgtgccgcacccacaccacaagcaggccggtcccgcggcccaccagctgcatgtgctgggctcccgcagccaggtgttcgccagcgacagccccccgcagagcctgctcactccctcgcggaacagcctcaacgtggacctgtatgaattgagcagcacctccgtccagcagtggccggctgccaccctggcccgccgggactccctgcagaagccgggcctggaggcgccgccgcgcgcgcacgtggccttccggcctgactgcccagtgcccagcaggaccaactccttcaacagccaccagccgcggcccggtccgcctggcaaggccgagccctccctgcccgcccccaacaccgtgacggctgtcacggccgcgcacatcttgcacccggtgaagagcgtgcgtgtgctgaggccggagccgcagacggctgtggggccctcgcaccccgcctgggtgcccgcgcctgccccggcccccgcccccgcccccgccccggctgcggagggcttggacgccaaggaggagcatgccctggcgctgggcggcgcaggcgccttcccgctggacgtggagtacggaggcccagaccggaggtgcccgcctccgccctacccgaagcacctgctgctgcgcagcaagtcggagcagtacgacctggacagcctgtgcgcaggcatggagcagagcctccgtgcgggccccaacgagcccgagggcggcgacaagagccgcaaaagcgccaagggggacaaaggcggaaaggataaaaagcagattcagacctctcccgttcccgtccgcaaaaacagcagagacgaagagaagagagagtcacgcatcaagagctactcgccatacgcctttaagttcttcatggagcagcacgtggagaatgtcatcaaaacctaccagcagaaggttaaccggaggctgcagctggagcaagaaatggccaaagctggactctgtgaagctgagcaggagcagatgcggaagatcctctaccagaaagagtctaattacaacaggttaaagagggccaagatggacaagtctatgtttgtcaagatcaaaaccctggggatcggtgcctttggagaagtgtgccttgcttgtaaggtggacactcacgccctgtacgccatgaagaccctaaggaaaaaggatgtcctgaaccggaatcaggtggcccacgtcaaggccgagagggacatcctggccgaggcagacaatgagtgggtggtcaaactctactactccttccaagacaaagacagcctgtactttgtgatggactacatccctggtggggacatgatgagcctgctgatccggatggaggtcttccctgagcacctggcccggttctacatcgcagagctgactttggccattgagagtgtccacaagatgggcttcatccaccgagacatcaagcctgataacattttgatagatctggatggtcacattaaactcacagatttcggcctctgcactgggttcaggtggactcacaattccaaatattaccagaaagggagccatgtcagacaggacagcatggagcccagcgacctctgggatgatgtgtctaactgtcggtgtggggacaggctgaagaccctagagcagagggcgcggaagcagcaccagaggtgcctggcacattcactggtggggactccaaactacatcgcacccgaggtgctcctccgcaaagggtacactcaactctgtgactggtggagtgttggagtgattctcttcgagatgctggtggggcagccgccctttttggcacctactcccacagaaacccagctgaaggtgatcaactgggagaacacgctccacattccagcccaggtgaagctgagccctgaggccagggacctcatcaccaagctgtgctgctccgcagaccaccgcctggggcggaatggggccgatgacctgaaggcccaccccttcttcagcgccattgacttctccagtgacatccggaagcagccagccccctacgttcccaccatcagccaccccatggacacctcgaatttcgaccccgtagatgaagaaagcccttggaacgatgccagcgaaggtagcaccaaggcctgggacacactcacctcgcccaataacaagcatcctgagcacgcattttacgaattcaccttccgaaggttctttgatgacaatggctacccctttcgatgcccaaagccttcaggagcagaagcttcacaggctgagagctcagatttagaaagctctgatctggtggatcagactgaaggctgccagcctgtgtacgtgtagatgggggccaggcacccccaccactcgctgcctcccaggtcagggtcccggagccggtgccctcacaggccaatagggaagccgagggctgttttgttttaaattagtccgtcgattacttcacttgaaattctgctcttcaccaagaaaacccaaacaggacacttttgaaaacaggactcagcatcgctttcaataggcttttcaggaccttcactgcattaaaacaatatttttgaaaatttagtacagtttagaaagagcacttattttgtttatatccattttttcttactaaattatagggattaactttgacaaatcatgctgctgttattttctacatttgtattttatccatagcacttattcacatttaggaaaagacataaaaactgaagaacattgatgagaaatctctgtgcaataatgtaaaaaaaaaaaaagataacactctgctcaatgtcacggagaccattttatccacacaatggtttttgttttttattttttcccatgtttcaaaattgtgatataatgatataatgttaaaagctgctttttttggctttttgcatatctagtataataggaagtgtgagcaaggtgatgatgtggctgtgatttccgacgtctggtgtgtggagagtactgcatgagcagagttcttctattataaaattaccatatcttgccattcacagcaggtcctgtgaatacgtttttactgagtgtctttaaatgaggtgttctagacagtgtgctgataatgtattgtgcgggtgacctcttcgctatgattgtatctcttactgttttgttaaagaaatgcagatgtgtaactgagaagtgatttgtgtgtgtgtcttggttgtgattggattctttggggggggggaactgaaacatttgtcatatactgaacttatatacatcaaaagggattaatacagcgatgccaaaaagtttaatcacggacacacgtccgtttctgtagtccgtatgctctttcattcttggtagagctggtatgtggaatgccatacctctgaccctactacttacctttttactgacagactgcccacactgaaagcttcagtgaatgttcttagtcctgttttcttctgttactgtcaggaaactgagtgatctaatggttctctcactttttttttgttcttttagtgtactttgaagtatcaaatcttaacttggtttaaacaatacatattcctaacctttgtaaaaaagcaaagattcttcaaaatgacattgaaataaaaagtaagccatacgtattttcttagaagtatagatgtatgtgcgtgtatacacacacacacacacacagagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagcttctactggcacaatttattattaaaattttgaatccaaagttttttaagaagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacatnaatgctaacacttttt

SEQ ID NO: 309322 - DNA, 5289 bp, Homo sapiens
gaaatcctaagaccttgctgtgttattgaccatcaatctcagacactgtctgggctctccggcagcgtggagagtcctggccccgcctcgagaacagaggccaaggacgggaagtgcaggggtccgtgtacttgcagttgggttctattctacccacacggtgtcttacaagttttttaaaaatgtctttccaacttttaagaaccaagagctttcacactgaaaattgggcctggagagggggcgagcgcctgtggtcccagtgtgtcaggagactgaggcaggaggatgggacgtagtgagaccctatctctaaaaagaaaaaaaaaaaggaattaagaaaattgggtttttagcattcctagaaatgtagaagccctgagctgcgtctcctgtgtgggagctggtcccactccccggccttcggagccctcggagcccggagccctcgatgcagcgctatggatgccgggagcgatctttggaaaggagtccccggctcgagcgacactgcccccctggggctctgcaggagatggctggccgagctctcaagcagactggcagcaggagcatcgaggccgccctggagtacatcagcaagatgggctacctggacccgaggaatgagcagattgtgcgggtcattaagcagacctccccaggaaaggggctcatgccaaccccagtgacgcggaggcccagcttcgaaggaaccggcgattcgtttgcgtcctaccaccagctgagcggtaccccctacgagggcccaagcttcggcgctgacggccccacggcgctggaggagatgccgcggccgtacgtggactaccttttccccggagtcggcccccacgggcccggccaccagcaccagcacccacccaagggctacggtgccagcgtagaggcagcaggggcacacttcccgctgcagggcgcgcactacgggcggccgcacctgctggtgcctggggaacccctgggctacggagtgcagcgcagcccctccttccagagcaagacgccgccggagaccgggggttacgccagcctgcccacgaagggccagggaggaccgccaggcgccggcctcgctttcccaccccctgccgccgggctctacgtgccgcacccacaccacaagcaggccggtcccgcggcccaccagctgcatgtgctgggctcccgcagccaggtgttcgccagcgacagccccccgcagagcctgctcactccctcgcggaacagcctcaacgtggacctgtatgaattgagcagcacctccgtccagcagtggccggctgccaccctggcccgccgggactccctgcagaagccgggcctggaggcgccgccgcgcgcgcacgtggccttccggcctgactgcccagtgcccagcaggaccaactccttcaacagccaccagccgcggcccggtccgcctggcaaggccgagccctccctgcccgcccccaacaccgtgacggctgtcacggccgcgcacatcttgcacccggtgaagagcgtgcgtgtgctgaggccggagccgcagacggctgtggggccctcgcaccccgcctgggtgcccgcgcctgccccggcccccgcccccgcccccgccccggctgcggagggcttggacgccaaggaggagcatgccctggcgctgggcggcgcaggcgccttcccgctggacgtggagtacggaggcccagaccggaggtgcccgcctccgccctacccgaagcacctgctgctgcgcagcaagtcggagcagtacgacctggacagcctgtgcgcaggcatggagcagagcctccgtgcgggccccaacgagcccgagggcggcgacaagagccgcaaaagcgccaagggggacaaaggcggaaaggataaaaagcagattcagacctctcccgttcccgtccgcaaaaacagcagagacgaagagaagagagagtcacgcatcaagagctactcgccatacgcctttaagttcttcatggagcagcacgtggagaatgtcatcaaaacctaccagcagaaggttaaccggaggctgcagctggagcaagaaatggccaaagctggactctgtgaagctgagcaggagcagatgcggaagatcctctaccagaaagagtctaattacaacaggttaaagagggccaagatggacaagtctatgtttgtcaagatcaaaaccctggggatcggtgcctttggagaagtgtgccttgcttgtaaggtggacactcacgccctgtacgccatgaagaccctaaggaaaaaggatgtcctgaaccggaatcaggtggcccacgtcaaggccgagagggacatcctggccgaggcagacaatgagtgggtggtcaaactctactactccttccaagacaaagacagcctgtactttgtgatggactacatccctggtggggacatgatgagcctgctgatccggatggaggtcttccctgagcacctggcccggttctacatcgcagagctgactttggccattgagagtgtccacaagatgggcttcatccaccgagacatcaagcctgataacattttgatagatctggatggtcacattaaactcacagatttcggcctctgcactgggttcaggtggactcacaattccaaatattaccagaaagggagccatgtcagacaggacagcatggagcccagcgacctctgggatgatgtgtctaactgtcggtgtggggacaggctgaagaccctagagcagagggcgcggaagcagcaccagaggtgcctggcacattcactggtggggactccaaactacatcgcacccgaggtgctcctccgcaaagggtacactcaactctgtgactggtggagtgttggagtgattctcttcgagatgctggtggggcagccgccctttttggcacctactcccacagaaacccagctgaaggtgatcaactgggagaacacgctccacattccagcccaggtgaagctgagccctgaggccagggacctcatcaccaagctgtgctgctccgcagaccaccgcctggggcggaatggggccgatgacctgaaggcccaccccttcttcagcgccattgacttctccagtgacatccggaagcagccagccccctacgttcccaccatcagccaccccatggacacctcgaatttcgaccccgtagatgaagaaagcccttggaacgatgccagcgaaggtagcaccaaggcctgggacacactcacctcgcccaataacaagcatcctgagcacgcattttacgaattcaccttccgaaggttctttgatgacaatggctacccctttcgatgcccaaagccttcaggagcagaagcttcacaggctgagagctcagatttagaaagctctgatctggtggatcagactgaaggctgccagcctgtgtacgtgtagatgggggccaggcacccccaccactcgctgcctcccaggtcagggtcccggagccggtgccctcacaggccaatagggaagccgagggctgttttgttttaaattagtccgtcgattacttcacttgaaattctgctcttcaccaagaaaacccaaacaggacacttttgaaaacaggactcagcatcgctttcaataggcttttcaggaccttcactgcattaaaacaatatttttgaaaatttagtacagtttagaaagagcacttattttgtttatatccattttttcttactaaattatagggattaactttgacaaatcatgctgctgttattttctacatttgtattttatccatagcacttattcacatttaggaaaagacataaaaactgaagaacattgatgagaaatctctgtgcaataatgtaaaaaaaaaaaaagataacactctgctcaatgtcacggagaccattttatccacacaatggtttttgttttttattttttcccatgtttcaaaattgtgatataatgatataatgttaaaagctgctttttttggctttttgcatatctagtataataggaagtgtgagcaaggtgatgatgtggctgtgatttccgacgtctggtgtgtggagagtactgcatgagcagagttcttctattataaaattaccatatcttgccattcacagcaggtcctgtgaatacgtttttactgagtgtctttaaatgaggtgttctagacagtgtgctgataatgtattgtgcgggtgacctcttcgctatgattgtatctcttactgttttgttaaagaaatgcagatgtgtaactgagaagtgatttgtgtgtgtgtcttggttgtgattggattctttggggggggggaactgaaacatttgtcatatactgaacttatatacatcaaaagggattaatacagcgatgccaaaaagtttaatcacggacacacgtccgtttctgtagtccgtatgctctttcattcttggtagagctggtatgtggaatgccatacctctgaccctactacttacctttttactgacagactgcccacactgaaagcttcagtgaatgttcttagtcctgttttcttctgttactgtcaggaaactgagtgatctaatggttctctcactttttttttgttcttttagtgtactttgaagtatcaaatcttaacttggtttaaacaatacatattcctaacctttgtaaaaaagcaaagattcttcaaaatgacattgaaataaaaagtaagccatacgtattttcttagaagtatagatgtatgtgcgtgtatacacacacacacacacacagagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagcttctactggcacaatttattattaaaattttgaatccaaa

SEQ ID NO: 309323 - DNA, 2881 bp, Homo sapiens
  misc_feature (40)..(40): n is a, c, g, or t
  misc_feature (42)..(42): n is a, c, g, or t
  misc_feature (53)..(54): n is a, c, g, or t
  misc_feature (60)..(60): n is a, c, g, or t
  misc_feature (76)..(76): n is a, c, g, or t
  misc_feature (101)..(101): n is a, c, g, or t
agtctttccggagtagtaagttacaatatgggagattatncngaagcctggtnngataanaatataaacttcaggntgaccgaaaaatcagaataggtgtnggagacacaccgaatgcggtgtgtgtccacaagatgggcttcatccaccgagacatcaagcctgataacattttgatagatctggatggtcacattaaactcacagatttcggcctctgcactgggttcaggtggactcacaattccaaatattaccagaaagggagccatgtcagacaggacagcatggagcccagcgacctctgggatgatgtgtctaactgtcggtgtggggacaggctgaagaccctagagcagagggcgcggaagcagcaccagaggtgcctggcacattcactggtggggactccaaactacatcgcacccgaggtgctcctccgcaaagggtacactcaactctgtgactggtggagtgttggagtgattctcttcgagatgctggtggggcagccgccctttttggcacctactcccacagaaacccagctgaaggtgatcaactgggagaacacgctccacattccagcccaggtgaagctgagccctgaggccagggacctcatcaccaagctgtgctgctccgcagaccaccgcctggggcggaatggggccgatgacctgaaggcccaccccttcttcagcgccattgacttctccagtgacatccggaagcagccagccccctacgttcccaccatcagccaccccatggacacctcgaatttcgaccccgtagatgaagaaagcccttggaacgatgccagcgaaggtagcaccaaggcctgggacacactcacctcgcccaataacaagcatcctgagcacgcattttacgaattcaccttccgaaggttctttgatgacaatggctacccctttcgatgcccaaagccttcaggagcagaagcttcacaggctgagagctcagatttagaaagctctgatctggtggatcagactgaaggctgccagcctgtgtacgtgtagatgggggccaggcacccccaccactcgctgcctcccaggtcagggtcccggagccggtgccctcacaggccaatagggaagccgagggctgttttgttttaaattagtccgtcgattacttcacttgaaattctgctcttcaccaagaaaacccaaacaggacacttttgaaaacaggactcagcatcgctttcaataggcttttcaggaccttcactgcattaaaacaatatttttgaaaatttagtacagtttagaaagagcacttattttgtttatatccattttttcttactaaattatagggattaactttgacaaatcatgctgctgttattttctacatttgtattttatccatagcacttattcacatttaggaaaagacataaaaactgaagaacattgatgagaaatctctgtgcaataatgtaaaaaaaaaaaaagataacactctgctcaatgtcacggagaccattttatccacacaatggtttttgttttttattttttcccatgtttcaaaattgtgatataatgatataatgttaaaagctgctttttttggctttttgcatatctagtataataggaagtgtgagcaaggtgatgatgtggctgtgatttccgacgtctggtgtgtggagagtactgcatgagcagagttcttctattataaaattaccatatcttgccattcacagcaggtcctgtgaatacgtttttactgagtgtctttaaatgaggtgttctagacagtgtgctgataatgtattgtgcgggtgacctcttcgctatgattgtatctcttactgttttgttaaagaaatgcagatgtgtaactgagaagtgatttgtgtgtgtgtcttggttgtgattggattctttggggggggggaactgaaacatttgtcatatactgaacttatatacatcaaaagggattaatacagcgatgccaaaaagtttaatcacggacacacgtccgtttctgtagtccgtatgctctttcattcttggtagagctggtatgtggaatgccatacctctgaccctactacttacctttttactgacagactgcccacactgaaagcttcagtgaatgttcttagtcctgttttcttctgttactgtcaggaaactgagtgatctaatggttctctcactttttttttgttcttttagtgtactttgaagtatcaaatcttaacttggtttaaacaatacatattcctaacctttgtaaaaaagcaaagattcttcaaaatgacattgaaataaaaagtaagccatacgtattttcttagaagtatagatgtatgtgcgtgtatacacacacacacacacacagagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagcttctactggcacaatttattattaaaattttgaatccaaa

SEQ ID NO: 309324 - DNA, 2919 bp, Homo sapiens
atcccaggagtttgggaggccgagaagggcggatcacctgaggtcaggagttcaagaccagcctggcccacatggcaaaaccccatatctataaaaatacaaaaatcagccgggtgtggtggcaggcgcctgtaatcccagctactcgggaggctgaggcaggagaatcgcttgaacccaggaggcggaggttgcagtgagccaagatcgcaccactgcactccaacctgggcaacacagcgagactccatctcaaaaaaataaaaagaaagaaagaacttgtagaccatcattctctttcatttttgtggaaagcacaaaattctttggctaaacagtatttctgatagaagaaaatcagtatctttttgtctgtatttgactggtcatcctggcctcaggctgtgagccatcgactgaaatgacactgactttttgtggctgctgagatcaacaactgctgcttgtgtctattctaactcctctcctattgtgaaactaaacatatttgaaagtcacgtcatcacacgctgtcccagaactgcccaagatgtgaggagaaactaacctgttggctctgttgtttcctcaggtgatcaactgggagaacacgctccacattccagcccaggtgaagctgagccctgaggccagggacctcatcaccaagctgtgctgctccgcagaccaccgcctggggcggaatggggccgatgacctgaaggcccaccccttcttcagcgccattgacttctccagtgacatccggaagcagccagccccctacgttcccaccatcagccaccccatggacacctcgaatttcgaccccgtagatgaagaaagcccttggaacgatgccagcgaaggtagcaccaaggcctgggacacactcacctcgcccaataacaagcatcctgagcacgcattttacgaattcaccttccgaaggttctttgatgacaatggctacccctttcgatgcccaaagccttcaggagcagaagcttcacaggctgagagctcagatttagaaagctctgatctggtggatcagactgaaggctgccagcctgtgtacgtgtagatgggggccaggcacccccaccactcgctgcctcccaggtcagggtcccggagccggtgccctcacaggccaatagggaagccgagggctgttttgttttaaattagtccgtcgattacttcacttgaaattctgctcttcaccaagaaaacccaaacaggacacttttgaaaacaggactcagcatcgctttcaataggcttttcaggaccttcactgcattaaaacaatatttttgaaaatttagtacagtttagaaagagcacttattttgtttatatccattttttcttactaaattatagggattaactttgacaaatcatgctgctgttattttctacatttgtattttatccatagcacttattcacatttaggaaaagacataaaaactgaagaacattgatgagaaatctctgtgcaataatgtaaaaaaaaaaaaagataacactctgctcaatgtcacggagaccattttatccacacaatggtttttgttttttattttttcccatgtttcaaaattgtgatataatgatataatgttaaaagctgctttttttggctttttgcatatctagtataataggaagtgtgagcaaggtgatgatgtggctgtgatttccgacgtctggtgtgtggagagtactgcatgagcagagttcttctattataaaattaccatatcttgccattcacagcaggtcctgtgaatacgtttttactgagtgtctttaaatgaggtgttctagacagtgtgctgataatgtattgtgcgggtgacctcttcgctatgattgtatctcttactgttttgttaaagaaatgcagatgtgtaactgagaagtgatttgtgtgtgtgtcttggttgtgattggattctttggggggggggaactgaaacatttgtcatatactgaacttatatacatcaaaagggattaatacagcgatgccaaaaagtttaatcacggacacacgtccgtttctgtagtccgtatgctctttcattcttggtagagctggtatgtggaatgccatacctctgaccctactacttacctttttactgacagactgcccacactgaaagcttcagtgaatgttcttagtcctgttttcttctgttactgtcaggaaactgagtgatctaatggttctctcactttttttttgttcttttagtgtactttgaagtatcaaatcttaacttggtttaaacaatacatattcctaacctttgtaaaaaagcaaagattcttcaaaatgacattgaaataaaaagtaagccatacgtattttcttagaagtatagatgtatgtgcgtgtatacacacacacacacacacagagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagcttctactggcacaatttattattaaaattttgaatccaaa

SEQ ID NO: 309325 - DNA, 3914 bp, Homo sapiens
gtctgcgctttggaaccgcggcgtgagcgccccgggaagatggagcagtcgccgtccacgccaccgccgccgcccggggctcccccgtccctgcggggccagcagcagctccagccaccagtgcccggtctcccggcgcgagaggcccgggagccgccggccaggacgcccccgagggtgtagaccgcgcccctggagagagtgataatcttcaaaatgaagactttggaaaattttaggttctctataggaactacaaaaatggaaggaaagaacattttcaaaaggaaattattttgaaagtatgtttacaacaaactgatactattgacagtttttttttttaaataataaaacactttaagaagattgtatttatggtaaaaggaaactggactaacaatgaggccaaagacttttcctgccacgacttattctggaaatagccggcagcgactgcaagagattcgtgaggggttaaaacagccatccaagtcttcggttcaggggctacccgcaggaccaaacagtgacacttccctggatgccaaagtcctggggagcaaagatgccaccaggcagcagcagcagatgagagccaccccaaagttcggaccttatcagaaagccttgagggaaatcagatattccttgttgccttttgctaatgaatcgggcacctctgcagctgcagaagtgaaccggcaaatgctgcaggaactggtgaacgcaggatgcgaccaggagatggctggccgagctctcaagcagactggcagcaggagcatcgaggccgccctggagtacatcagcaagatgggctacctggacccgaggaatgagcagattgtgcgggtcattaagcagacctccccaggaaaggggctcatgccaaccccagtgacgcggaggcccagcttcgaaggaaccggcgattcgtttgcgtcctaccaccagctgagcggtaccccctacgagggcccaagcttcggcgctgacggccccacggcgctggaggagatgccgcggccgtacgtggactaccttttccccggagtcggcccccacgggcccggccaccagcaccagcacccacccaagggctacggtgccagcgtagaggcagcaggggcacacttcccgctgcagggcgcgcactacgggcggccgcacctgctggtgcctggggaacccctgggctacggagtgcagcgcagcccctccttccagagcaagacgccgccggagaccgggggttacgccagcctgcccacgaagggccagggaggaccgccaggcgccggcctcgctttcccaccccctgccgccgggctctacgtgccgcacccacaccacaagcaggccggtcccgcggcccaccagctgcatgtgctgggctcccgcagccaggtgttcgccagcgacagccccccgcagagcctgctcactccctcgcggaacagcctcaacgtggacctgtatgaattgagcagcacctccgtccagcagtggccggctgccaccctggcccgccgggactccctgcagaagccgggcctggaggcgccgccgcgcgcgcacgtggccttccggcctgactgcccagtgcccagcaggaccaactccttcaacagccaccagccgcggcccggtccgcctggcaaggccgagccctccctgcccgcccccaacaccgtgacggctgtcacggccgcgcacatcttgcacccggtgaagagcgtgcgtgtgctgaggccggagccgcagacggctgtggggccctcgcaccccgcctgggtgcccgcgcctgccccggcccccgcccccgcccccgccccggctgcggagggcttggacgccaaggaggagcatgccctggcgctgggcggcgcaggcgccttcccgctggacgtggagtacggaggcccagaccggaggtgcccgcctccgccctacccgaagcacctgctgctgcgcagcaagtcggagcagtacgacctggacagcctgtgcgcaggcatggagcagagcctccgtgcgggccccaacgagcccgagggcggcgacaagagccgcaaaagcgccaagggggacaaaggcggaaaggataaaaagcagattcagacctctcccgttcccgtccgcaaaaacagcagagacgaagagaagagagagtcacgcatcaagagctactcgccatacgcctttaagttcttcatggagcagcacgtggagaatgtcatcaaaacctaccagcagaaggttaaccggaggctgcagctggagcaagaaatggccaaagctggactctgtgaagctgagcaggagcagatgcggaagatcctctaccagaaagagtctaattacaacaggttaaagagggccaagatggacaagtctatgtttgtcaagatcaaaaccctggggatcggtgcctttggagaagtgtgccttgcttgtaaggtggacactcacgccctgtacgccatgaagaccctaaggaaaaaggatgtcctgaaccggaatcaggtggcccacgtcaaggccgagagggacatcctggccgaggcagacaatgagtgggtggtcaaactctactactccttccaagacaaagacagcctgtactttgtgatggactacatccctggtggggacatgatgagcctgctgatccggatggaggtcttccctgagcacctggcccggttctacatcgcagagctgactttggccattgagagtgtccacaagatgggcttcatccaccgagacatcaagcctgataacattttgatagatctggatggtcacattaaactcacagatttcggcctctgcactgggttcaggtggactcacaattccaaatattaccagaaagggagccatgtcagacaggacagcatggagcccagcgacctctgggatgatgtgtctaactgtcggtgtggggacaggctgaagaccctagagcagagggcgcggaagcagcaccagaggtgcctggcacattcactggtggggactccaaactacatcgcacccgaggtgctcctccgcaaagggtacactcaactctgtgactggtggagtgttggagtgattctcttcgagatgctggtggggcagccgccctttttggcacctactcccacagaaacccagctgaaggtgatcaactgggagaacacgctccacattccagcccaggtgaagctgagccctgaggccagggacctcatcaccaagctgtgctgctccgcagaccaccgcctggggcggaatggggccgatgacctgaaggcccaccccttcttcagcgccattgacttctccagtgacatccggaagcagccagccccctacgttcccaccatcagccaccccatggacacctcgaatttcgaccccgtagatgaagaaagcccttggaacgatgccagcgaaggtagcaccaaggcctgggacacactcacctcgcccaataacaagcatcctgagcacgcattttacgaattcaccttccgaaggttctttgatgacaatggctacccctttcgatgcccaaagccttcaggagcagaagcttcacaggctgagagctcagatttagaaagctctgatctggtggatcagactgaaggctgccagcctgtgtacgtgtagatgggggccaggcacccccaccactcgctgcctcccaggtcagggtcccggagccggtgccctcacaggccaatagggaagccgagggctgttttgttttaaattagtccgtcgattacttcacttgaaattctgctcttcaccaagaaaacccaaacaggacacttttgaaaacaggactcagcatcgctttcaataggcttttcaggaccttcactgcattaaaacaatatttttgaaaattt

SEQ ID NO: 309326 - DNA, 1364 bp, Homo sapiens
gtctgcgctttggaaccgcggcgtgagcgccccgggaagatggagcagtcgccgtccacgccaccgccgccgcccggggctcccccgtccctgcggggccagcagcagctccagccaccagtgcccggtctcccggcgcgagaggcccgggagccgccggccaggacgcccccgagggtgtagaccgcgcccctggagagagtgataatcttcaaaatgaagactttggaaaattttaggttctctataggaactacaaaaatggaaggaaagaacattttcaaaaggaaattattttgaaagtatgtttacaacaaactgatactattgacagtttttttttttaaataataaaacactttaagaagattgtatttatggtaaaaggaaactggactaacaatgaggccaaagacttttcctgccacgacttattctggaaatagccggcagcgactgcaagagattcgtgaggggttaaaacagccatccaagtcttcggttcaggggctacccgcaggaccaaacagtgacacttccctggatgccaaagtcctggggagcaaagatgccaccaggcagcagcagcagatgagagccaccccaaagttcggaccttatcagaaagcttcagtgaatgttcttagtcctgttttcttctgttactgtcaggaaactgagtgatctaatggttctctcactttttttttgttcttttagtgtactttgaagtatcaaatcttaacttggtttaaacaatacatattcctaacctttgtaaaaaagcaaagattcttcaaaatgacattgaaataaaaagtaagccatacgtattttcttagaagtatagatgtatgtgcgtgtatacacacacacacacacacagagataaacacaatattccttatttcaaattagtatgattcctatttaaagtgatttatatttgagtaaaaagttcaattcttttttgctttttaaaaaatctgatgcttcataattttcattatattattccacatatttttccttgaagttcttagcataatgtatccattacttagtatatatctaggcaacaacacttagaagtttatcagtgtttaaactaaaaaaataaagattcctgtgtactggtttacatttgtgtgagtggcatactcaagtctgctgtgcctgtcgtcgtgactgtcagtattctcgctattttatagtcgtgccatgttgttactcacagcgctctgacatactttcatgtggtaggttctttctcaggaactcagtttaactattatttattgatatatcattacctttgaaaagcttctactggcacaatttattattaaaattttgaatccaaa

SEQ ID NO: 309327 - DNA, 348 bp, Homo sapiens
gcacgaggaccagaatcccaagagccagagactggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttaga

SEQ ID NO: 309328 - DNA, 4184 bp, Homo sapiens
cctgtggacggccgcgttttaatgtgaccgggcgtcggatgtactggtgtccgtctcccagcatgctctagagaggcggctctggtgcccatcctcccagcacgctctggggaggcggctctggtgcccatcctcccagcatgctctggagaggcggctctggtgcccctcctcccagcatgctctggggaggcggctctggctctcgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgcgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagagttcagttgatccaacactttcctttaaaagttgagggagcagaggcccatgggattaaatggctggtccaggtcagccagcaggtgtagggcctgacaagaacatattgtttccctgacccctaggccgtcacaccacaccctccatttcctcatgttgctgaccaggtgcccatatgatttctacacttcccaagccttaccctggcatctttcttttaaattatatctgtcccaggtgctctccacacataggatggtaatgccagtcccaggggagggtgtgatagtaaggaaggccactgttaggtttcctttagaaataaagagatctcagcagcttggaagaaatcccagaagcggactccatcaatccaagaaagagttgctttgtggaaggtgaaggaagacccacagagtgctcaggatgatgctattgctggagagcgaaagatggaacagccttgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgagatgaattaagacaaagaacaggtgccatagaagtagatttctaggaatgaagtggggcagatcttatctttgtggattacaggcactgtactaaaaacaggtttcctatttaatataaaaagaaagtgaatcttcttttggatagaatcatccattcccatcgccgcaccccctaccccccaaacacacacacacacacacacacacacacacacacacacacacacacgccctactcttcatttgctaggggaaggtcacagcacaactaaatccaggacaggacattgtgaccatgacccagccacagtcaataccagaaagatgattcagagtctgaagtggtgccccaggtgccaacaggataacctctaccccccgactttgtctctggggtcctgttccttcctgcaaagcccaatccaagactggcatggctcagaggttgtgagaaaggcatggactggaacaatcatgtccagaggggtctggagctttgtttcctgttcaccagcaaaaaatgtctctcccatttttctgaaagtggctgatgtaagaacaggcagaaggaaaaccctttttgtcaataactctgtccttaaggaatggtcctctgggagggctgtgctgctagtgggtacctcagtcacacacccccaaccccaggcagcctctagagccttcttgctttcattttccttgaatgtacataggaacaagggggaaagtctcttactgaagtgcctgaaacccaaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgctacaagaaaaaaat

SEQ ID NO: 309329 - DNA, 1750 bp, Homo sapiens
cctgtggacggccgcgttttaatgtgaccgggcgtcggatgtactggtgtccgtctcccagcatgctctagagaggcggctctggtgcccatcctcccagcacgctctggggaggcggctctggtgcccatcctcccagcatgctctggagaggcggctctggtgcccctcctcccagcatgctctggggaggcggctctggctctcgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgcgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttaga

SEQ ID NO: 309330 - DNA, 953 bp, Homo sapiens
caggtgtacgctcggttacgggatcaagctagagcttctagagacgccgttcttcctgtctcagcttggccagcctttcaacaatgttctctagtttcaagctccagcttctcagaaagaattaaagaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgctacaagaaaaaaat

SEQ ID NO: 309331 - DNA, 2556 bp, Homo sapiens
cctgtggacggccgcgttttaatgtgaccgggcgtcggatgtactggtgtccgtctcccagcatgctctagagaggcggctctggtgcccatcctcccagcacgctctggggaggcggctctggtgcccatcctcccagcatgctctggagaggcggctctggtgcccctcctcccagcatgctctggggaggcggctctggctctcgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgcgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagagttcagttgatccaacactttcctttaaaagttgagggagcagaggcccatgggattaaatggctggtccaggtcagccagcaggtgtagggcctgacaagaacatattgtttccctgacccctaggccgtcacaccacaccctccatttcctcatgttgctgaccaggtgcccatatgatttctacacttcccaagccttaccctggcatctttcttttaaattatatctgtcccaggtgctctccacacataggatggtaatgccagtcccaggggagggtgtgatagtaaggaaggccactgttaggtttcctttagaaataaagagatctcagcagcttggaagaaatcccagaagcggactccatcaatccaagaaagagttgctttgtggaaggtgaaggaagacccacagagtgctcaggatgatgctattgctggagagcgaaagatggaacagccttgtccaggcagaacagtcataagccaggaaatgaaacaaaggaaaacaggtgcctgaatttcctggggaaacatggcttgtttaaggacttggagttatggatggaatttatgggacccacgtgagcagacctgaggaaggctcgatttcttttgtttcttggtccactctgtcactctgctctggtcaagccccatttggtctacagcccatgagaaggaatgaggctggttctgcactctcagcatgcagtccgaaagcatgtgggagtggggagggaaagtgaaatacataacacaaccaggagcacgaatgttcaggtacacgagctcgattcgtaa

SEQ ID NO: 309332 - DNA, 2315 bp, Homo sapiens
cctgtggacggccgcgttttaatgtgaccgggcgtcggatgtactggtgtccgtctcccagcatgctctagagaggcggctctggtgcccatcctcccagcacgctctggggaggcggctctggtgcccatcctcccagcatgctctggagaggcggctctggtgcccctcctcccagcatgctctggggaggcggctctggctctcgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgcgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccagctacggccagaaagggccaggtgggacctgaaagcaaagacaatgttctttaccacacgtttcacatctgcaacatccttcaattgcgggaaaaggaacttgatttaacagaagaacatggtagagcagcatccagaaagtctgttattcctcttggattttttgaaataatcttcagaggaaggaaggaaaatcctattttggggtatcagtgtttgactagggatcatgaaataataaactgaaaaaaactttagaaaaaaaaaaaaaaaaaaaaaaaaaaaaaaaaaaaaagaaaaaaaaacacaaaaaaaaaaaaaagaaaaaaaacaaaaagaagaggggcggcggcgcaaaaaatatctccccccggggggccccgaaagactgcgcgcgccccacgcatttgtgaacagagggccgcccctcatatggagggggctgttttatatttactccgtgaaagcggagccgcggctcgcggctataataaaaaaccgcagtgagtggtggagaaacaatcgtggctgctgatgaggaggaattaatcttgaggagaagaagacccaacactcattgggaggggggagcgacaactaatgtggggaaacacaccagcacgcagagaatgtattaaaagtcacccccacgcaagggggcatcttcaatgtcaacaataccagaaggatcaaaaaacgtgggacagaaaaacaacgacgagcattactttccgcccggcttcgaagaaaaacatggccgcaatcgacagtatataacatatccacaaaaacttttttacccaggcggagataaaaaacaggga

SEQ ID NO: 309333 - DNA, 1543 bp, Homo sapiens
  misc_feature (1531)..(1531): n is a, c, g, or t
cctgtggacggccgcgttttaatgtgaccgggcgtcggatgtactggtgtccgtctcccagcatgctctagagaggcggctctggtgcccatcctcccagcacgctctggggaggcggctctggtgcccatcctcccagcatgctctggagaggcggctctggtgcccctcctcccagcatgctctggggaggcggctctggctctcgccttcccagcatgccctttactacaaagggctatttttcttttctttcttttgtttatttatttttctttgttcactccctgtagaacttggatgaaatcagtgtccatggttctttatgtttgtagtcttgatgtgctcctgtggtattacttcccctctgataggacattgtagccagcctcagcactcagtgagttcatcagggccacacccagtagagaaggccaagcaacctccacttcttcagcaccacacacacgcacacacacacacacgcacacatgcgtgtgcacccgcgcacgcacatacacacacacatatagcagtagcagcagcagcagcagcagcagcaacctttgatcaggagtgagattttcgggttctgaaacctgggacacgagtctgcgaatagtcggttttctcagaataatttgaatctgttttcttagtttcaaatgaccatttccctgatgctctgagcttatgatcacacagagccagtccatcctcatttcctggtggcatctgttcatttacctttgtggactgtagctgatggcacagtgcgggttccctaccagccaggggtttccaagggacctttggaggccatgcttagacacattcctgtacctgagaacaaccacataggcaggaccagatccacatcgtgcagtcgtgtcataaaaaaacaaaacaaaacaaaaaaacactaggagtccactcaaccctggaggtctttgctaattggaattatgtattgtctgttgggctgggaaatgtctctttcatattgtaagtccaggatgaactaggagaaagcaatttgttgccctgatgataactgatgattttcaccctctctagctgaggtaactcagacagtgcatgaggtcagtttcttcttgagaagcagtgccttggtcttgtttctgtggttggttctagcccctgcagagcctgggagctgcaggaactgtctgagaaaatctccctaataggggagtgggttcccagaagggagatctgggaggggtcaggagccactaagttgcttcactccttttttctctaattttctaccttcctctctgttcctgcagacagttttgccagctttgcttctggttactagggtctcatgcgtgtcctgcttggagagccataaggaaattgctgtcttgtgctttgtgtctctcatccagtctctggctcttgggattctggtctttgagaaatagtccctgagtattaggatacttttatcaaaatctagtaccccccccgccccccccgccccccccggcccccccccgccccncccccgccccct

SEQ ID NO: 309334 - DNA, 3749 bp, Homo sapiens
ccctcggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggtttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgact

SEQ ID NO: 309335 - DNA, 3861 bp, Homo sapiens
  misc_feature (3770)..(3770): n is a, c, g, or t
  misc_feature (3861)..(3861): n is a, c, g, or t
ccctcggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggtttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgactaaaaaaaaaaaacctcctctnctcccctctatattcctatatttaatatccatcaaaaaaaacgcggttaaacgttggattgtcctgggttcacaattgcttgggcttcctn

SEQ ID NO: 309336 - DNA, 3847 bp, Homo sapiens
ccctcggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggtttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgactttgtaatttgattttctgaaatcagaccctgagaggggaaaatcttaaagtaaattacattaaattatctgtgcatttcacaccagggaaaatgacct

SEQ ID NO: 309337 - DNA, 3650 bp, Homo sapiens
tagatcacagcaaagatactcatttgttggtagtgccaggaagcaggcagtttccatggtaactgacagaccgagtttactgtggaaatttccggaattaacagagctgcattgcagaaggatgcataaagcagtattcatctagagatcgtaacagtacggacacagaagaacagttgcagtgatgtgcaggagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggtttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgact

SEQ ID NO: 309338 - DNA, 3646 bp, Homo sapiens
ccctcggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcaggagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggtttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgact

SEQ ID NO: 309339 - DNA, 3711 bp, Homo sapiens
ccctcggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggtttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgact

SEQ ID NO: 309340 - DNA, 3616 bp, Homo sapiens
ccctcggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagacacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggtttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgact

SEQ ID NO: 309341 - DNA, 2681 bp, Homo sapiens
caaattaattactatagcttccaaattaaaaaaacccggggcgcttactggtaacaagcagaatcctaaggccaaagtacaaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggtttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgact

SEQ ID NO: 309342 - DNA, 2049 bp, Homo sapiens
cgagctcggtacctgacagtaaaatgaacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggtttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgact

SEQ ID NO: 309343 - DNA, 1957 bp, Homo sapiens
ccctcggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattgtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtgccttacgaaggatgaatccaaaaggccaaagtataaagagcttctgaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacagga

SEQ ID NO: 309344 - DNA, 1355 bp, Homo sapiens
gaaaatctttctagatcattcgttatggcgcgcggtccctgtcacggtagaagtgaacaatggctcatagctcgtctatcctacgcatgatcctggtcatggactagtagctatgtgaagtgctcaccacgtaataatagaacgcccgagtgggagcgatgcctgttctgagacgaacatcctggatgccgcagtactgaggtcagttactggatctcattctaacgatggcagttccacatgcgtagcatcgcatcatcgatattacagccccgactcctgttggcattggaattctactggaaaaaaatacaaaaagcaaaacaaaaccctcagcactgttacaagaggccatttaagtatcttgtgcttcttcacttacccattagccaggttctcattaggtttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgact

SEQ ID NO: 309345 - DNA, 688 bp, Homo sapiens
  misc_feature (31)..(31): n is a, c, g, or t
gtcacagctgactctagaggatacactctcnctacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatgact

SEQ ID NO: 309346 - DNA, 1464 bp, Homo sapiens
ccctcggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaacgcaaagcactgaagttgaattttgcaaatccacctttcaaatctacagcaaggtttactctgaatcccaatcctacaggagttcaaaacccacacatagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaaagaattcggtcaacagtggatgaaaaagaacaaaaacaacttcttatggatttggatgtagtaatgcggagtagtgattgcccatacattgttcagttttatggtgcactcttcagagagggtgactgttggatctgtatggaactcatgtctacctcgtttgataagttttacaaatatgtatatagtgtattagatgatgttattccagaagaaattttaggcaaaatcactttagcaactgtgaaagcactaaaccacttaaaagaaaacttgaaaattattcacagagatatcaaaccttccaatattcttctggacagaagtggaaatattaagctctgtgacttcggcatcagtggacagcttgtggactctattgccaagacaagagatgctggctgtaggccatacatggcacctgaaagaatagacccaagcgcatcacgacaaggatatgatgtccgctctgatgtctggagtttggggatcacattggtatgtttatgctgattcaaccttgccacagtagcgtaacaataagaaatttagaagtgaaagaaaacttaatcagacttccccgttcgttaagaactataatcacagacactatggttttaagttgctgaaaaaaaaaaaaaaaaaaaaaaaaaaaaaaaatgtgggtggggggccggggccccggaaaagacttttagaaacacccatggcggggggcgcgcggggggccccgaggagggtaagaggtaacagggggcccaagaggaggtccaagggagaacccgcgggcccagaacaaaaggggggggaattcccaacaccaaaaaaaagcgcgcgccgcgggggaaaacagcgggtcgcgtttgggaacaaaaaacacagaagaggagcatctagagagggcgcaaaaggggggggactatatcaaaaaagggggggtccacagggaacaacccaggaaaactgaaaaaatttagccccccgcaggggggggggt

SEQ ID NO: 309347 - DNA, 630 bp, Homo sapiens
ataatttagtcaattttcaagaattaatattttttctaatttttaactaatcatcctacactgactatcctagagataaatcttcagattatagactcacaattttttgtatgtgcttttactgtgtttagcaggctgtctgcgttgttactttggatctgaaggaaagaactatttcattatttgtaatatttcatctgtgaaaagaaaaatacttaggcaaatgaatctacattttaataatgttatttttatgttattttagccttacgaaggatgaatccaaaaggccaaagtataaagagcttctggtgagtgtgggactgtggggattgtaggtacatcctaaccccggaactctcttaacatgctggttcactaagcaagcagtgggcctctctgtcataaacaaacatctcaaatttattgagtgttttttgttaatgtttttacacaaagatttggaaagagaaaatttgcagttataatttttctactaatactagctaaattctcatggaaaattttggtcttaacatgttataaaaattacccccaaagaattctgactttaagaagccattttccactgcatagtctatttatatgggatgcagccataagaaaaaa

SEQ ID NO: 309348 - DNA, 435 bp, Homo sapiens
gagctcggtacccaatcagtttacacaagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaccgtgcaagtcaataagccacccttgaaaactgtgtcaaaatttgaggaaa

SEQ ID NO: 309349 - DNA, 6033 bp, Homo sapiens
ctccttgggcgatcgcctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttcttttttttttttttttttggagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309350 - DNA, 6181 bp, Homo sapiens
ctccttgggcgatcgcctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttcttttttttttttttttttggagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccgaaaaaaaaaagggggcgcaaatttcccgagggccaattacgtcccttttcttaaagggctatggagttaaaagcggccgcttaagtccgtggaggttggttggagcctctgggtatgacctatgcgaaaatgtatgattttgtgtttac

SEQ ID NO: 309351 - DNA, 5990 bp, Homo sapiens
ctccttgggcgatcgcctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagcccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttcttttttttttttttttttggagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309352 - DNA, 5908 bp, Homo sapiens
ctccttgggcgatcgcctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagccaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttcttttttttttttttttttggagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309353 - DNA, 5931 bp, Homo sapiens
ctccttgggcgatcgcctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttcttttttttttttttttttggagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309354 - DNA, 6003 bp, Homo sapiens
ctccttgggcgatcgcctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttcttttttttttttttttttggagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309355 - DNA, 5410 bp, Homo sapiens
acccacacccacagccgcactcgcagccgcacgggcaccggcttctccgcagcacctccaactctgcctgaaaggggcagctcccgggcaagacaaggtaaggtcccggcactcgcgctcccgaggagtgggtctcgggggtagtgagttgggaggagtaggaagcttgttcacaggttcggctcctgtatggagaaatcaaaactcataccaagtttctggggcaatggaagaaacagaaacaagctggggccaggagagctgggcagagaggggaggctggggagatccgggccaggcagggggcctcgcggaccgcgcccgcgcccgcgcccatcacgaccgtccttgtgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttcttttttttttttttttttggagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309356 - DNA, 2959 bp, Homo sapiens
ctccttgggcgatcgcctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgcta

SEQ ID NO: 309357 - DNA, 1917 bp, Homo sapiens
ctccttgggcgatcgcctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttt

SEQ ID NO: 309358 - DNA, 3268 bp, Homo sapiens
ctccttgggcgatcgcctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctaaaaaaaaaaaaaaaaaaaaaaaaaaaaaaaaaaaaaaaaaaaaaaaaaaaaaaaaacaaaaaaaaaatactagagcaggagacctataaaaattctccccaaagaaatcacaacataaacacaacacattttttctcaacaacacagggacaacataaaagagactatataaataccgagaagaacccgcgcgcagtgttattacaaacactcaattagggcaaaaatgtgcattatcagaaaatcattgaggaagagacaaagaaaatgtggagaggataataaatgggcgccactcttttgatcaga

SEQ ID NO: 309359 - DNA, 4772 bp, Homo sapiens
gtatggccgtccgtgtaatccggtacagctattgccctctactatccgagattcagtaggcgcagcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttcttttttttttttttttttggagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309360 - DNA, 4837 bp, Homo sapiens
tttcacaattattacggcccgcctgtcgcactactactgttatgcgggcgcaggactcttcacgcgtacaagaggctacggcattactcacactcttcgctcatttatggaccctggtggttaaattgtgcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttcttttttttttttttttttggagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309361 - DNA, 4010 bp, Homo sapiens
ccctcacggtactcaaaaaaagtaatatcagagttttaatttcaaccagctggcacaacaatgaaagtgtcagacttcctgaaagtactcgagaaataatgaataaattcttaatgttttcccctccaccgcccttttttattctccaagattaggaattactacggattaggtttttgaaaataaagtttcctttttggaaaatggtctacattcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttcttttttttttttttttttggagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagagtaatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309362 - DNA, 1644 bp, Homo sapiens
ctccttgggcgatcgcctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagcccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggtaaggtcccggcactcgcgctcccgaggagtgggtctcgggggtagtgagttgggaggagtaggaagcttgttcacaggttcggctcctgtatggagaaatcaaaactcataccaagtttctggggcaatggaagaaacagaaacaagctggggccaggagagctgggcagagaggggaggctggggagatccgggccaggcagggggcctcgcggaccgcgcccgcgcccgcgcccatcacgaccgtccttgtcccgtggtgcgtcccccagccccacttgactatatgtttgggca

SEQ ID NO: 309363 - DNA, 931 bp, Homo sapiens
gacccacgcgtccgcggacgcgtgggtcgacccacgcgtccgattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309364 - DNA, 757 bp, Homo sapiens
gagctcggtacccaatcagtttacacaagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 309365 - DNA, 1005 bp, Homo sapiens
ttctttttggcatatctctttttctaacttttttttttctttttacaaaaaacaattgttatttgtgtacttttaaaacctcacagtaatattttcacactaccttcttggctgaaagttcacactcggaattccagagcagtccatggccaggcccactgggctccccttgctctctccttggctttggtaaccactggccccagggactcagcctgctttcctatccatcccctcagtagctgtcaccatgcaggttaccccttctgtcgtcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttcccaattgtgtacaattgaagcctctgctttatagctcttagcacacctctcaaataagaaggcagtactgggaaggctctgaacctgtggcagaaccactgatagctgtggagctattccaaggagtctgggaatcagggggattatcaagatcattgttagaataaattaatcttactgtatatatagcagaagttttcaagcatatgtaaatgctactaataaccaaataattacaccttgtttttctttaaactgtaactctcaagtatgtctctacataattttttgattggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaa

SEQ ID NO: 309366 - DNA, 2084 bp, Homo sapiens
cggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309367 - DNA, 1062 bp, Homo sapiens
cggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcaggtctgacatgactcgattagaagtgctggacgaacagtcccgcccagacgggataatcgccgggagaagtccgcgtgtgtgcattgtcccagaagcgtcgttcacactctttgtgcccggtccacatctcgggaattcttaactcgtgtactacctacgccgcgtggttcaaatcatgtgcaccttgtgtgttcctcggccccctcatccttctcgtctcacaccgaggcccccccgccctc

SEQ ID NO: 309368 - DNA, 807 bp, Homo sapiens
  misc_feature (756)..(756): n is a, c, g, or t
  misc_feature (786)..(786): n is a, c, g, or t
cggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgataacttgaaaaaagaaacgatgggtttctttgcccnccccaaagttttgctttttggccccgtggnaacccctggctgtttcttccc

SEQ ID NO: 309369 - DNA, 2543 bp, Homo sapiens
cggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaaggtggggtgctggggggctgccaggtgggttctgtggagtggaggggaccctgctgctgacttggttgctgcatgactttgggggctctctgccatgcctgggcctcccctttgtcagccacctttcttacttgaaaatttgggtcagggtccagatggtctcttagccctgggttgctgtagggcatgtgcccccccttcttacctctgagtcctgaggccctgaggaagggtggctggtggccagcccggccccaccctggtctgtttgtgtggctggtgccaagagccaggcccagcatgttcttcctgccaggggtgagtgggagagggcggcccaggctggattccagagctgcacctgcattctggcccagagcccccctgctggtgccagctgcaaggggagaccctgctgagggcaggccatcaagtgtgacttctgcctgccttcccccagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309370 - DNA, 2285 bp, Homo sapiens
cggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatatgtgagtgcttgcgggtaggggggtgcagcgagggttacccacagccccaagagaggggagttgcgggcatgagagtcagtctgaagcatctcgccacctctgagcagcctccagtagcctgagggggagcttgggtgggggtaccccaggctgctagggtgtaactgtcctcggtccgggaccgagtctgctcctccagggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309371 - DNA, 1985 bp, Homo sapiens
cggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309372 - DNA, 2178 bp, Homo sapiens
cggactcagcggcggaagtggcgctgccggaagatcttcttccgctctgaggcgctactgaggccgcggagccggactgcggttggggcgggaagagccggggccgtggctgacatggagcagtagagacgggtttcactgtgttagccagaatggtctcgatctcctgaccttgtgatccacccacctcccgcctcccagagtgctgggattacagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309373 - DNA, 2030 bp, Homo sapiens
  misc_feature (12)..(12): n is a, c, g, or t
  misc_feature (20)..(20): n is a, c, g, or t
  misc_feature (24)..(24): n is a, c, g, or t
  misc_feature (26)..(27): n is a, c, g, or t
  misc_feature (30)..(30): n is a, c, g, or t
  misc_feature (32)..(33): n is a, c, g, or t
tgaggccgcgcncccccccncccncnnccncnnccgcaacaccccccggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309374 - DNA, 2016 bp, Homo sapiens
ggcaggcccagaggctgttgacaggaccagaggctggagctcagggctaggcctgccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309375 - DNA, 2254 bp, Homo sapiens
ggcaggcccagaggctgttgacaggaccagaggctggagctcagggctaggcctggtaggagcaggctacagccccagggatccaggaggggccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatatgtgagtgcttgcgggtaggggggtgcagcgagggttacccacagccccaagagaggggagttgcgggcatgagagtcagtctgaagcatctcgccacctctgagcagcctccagtagcctgagggggagcttgggtgggggtaccccaggctgctagggtgtaactgtcctcggtccgggaccgagtctgctcctccagggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309376 - DNA, 2030 bp, Homo sapiens
cggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcgctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309377 - DNA, 1827 bp, Homo sapiens
cctgggtggtggcttagcatcaacagcctcccctccaggttcctccatcccctacctcttgccccttccgggaggtgaggggcagccccaggcccttgcttctacctgcagagctcttcctgtctccctctcacagaccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309378 - DNA, 2744 bp, Homo sapiens
cggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatatgtgagtgcttgcgggtaggggggtgcagcgagggttacccacagccccaagagaggggagttgcgggcatgagagtcagtctgaagcatctcgccacctctgagcagcctccagtagcctgagggggagcttgggtgggggtaccccaggctgctagggtgtaactgtcctcggtccgggaccgagtctgctcctccagggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaaggtggggtgctggggggctgccaggtgggttctgtggagtggaggggaccctgctgctgacttggttgctgcatgactttgggggctctctgccatgcctgggcctcccctttgtcagccacctttcttacttgaaaatttgggtcagggtccagatggtctcttagccctgggttgctgtagggcatgtgcccccccttcttacctctgagtcctgaggccctgaggaagggtggctggtggccagcccggccccaccctggtctgtttgtgtggctggtgccaagagccaggcccagcatgttcttcctgccaggggtgagtgggagagggcggcccaggctggattccagagctgcacctgcattctggcccagagcccccctgctggtgccagctgcaaggggagaccctgctgagggcaggccatcaagtgtgacttctgcctgccttcccccagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309379 - DNA, 2066 bp, Homo sapiens
cctgggtggtggcttagcatcaacagcctcccctccaggttcctccatcccctacctcttgccccttccgggaggtgaggggcagccccaggcccttgcttctacctgcagagctcttcctgtctccctctcacagaccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcgcctctgccttccccttcctccctccctcccctgggcaggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatatgtgagtgcttgcgggtaggggggtgcagcgagggttacccacagccccaagagaggggagttgcgggcatgagagtcagtctgaagcatctcgccacctctgagcagcctccagtagcctgagggggagcttgggtgggggtaccccaggctgctagggtgtaactgtcctcggtccgggaccgagtctgctcctccagggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309380 - DNA, 1597 bp, Homo sapiens
gtgttcagaggatccccctacgtatatgtcgtgctgcagctcggcactggtgggtgatagcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309381 - DNA, 1142 bp, Homo sapiens
tgaatagaactgtccctcggacagagcaccggagaacagcaggggtccacgggcaacagcaacctgggcggcaagatgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaagggccgcctgccccggtacctcatccaccagagcctcgcggccaccatgtttgaatttgcctttcacctgcgacagcgcatcagcgagctgggggcccgggcgtgactgtgccccctcccaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgtttacatggcgccctgcctcctggaggaccagattgctctgccccaccttgccagggcagggtctgggctgggcacctgacttggctggggaggaccagggccctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309382 - DNA, 1862 bp, Homo sapiens
cggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaagaccttcctgccctgtcctgcggagctcgtgtaccaggaggtgatcctgcagcccgagaggatggtgctgtggaacaagacagtgactgcctgccagatcctgcagcgagtggaagacaacaccctcatctcctatgacgtgtctgcaggggctgcgggcggcgtggtctccccaagggacttcgtgaatgtccggcgcattgagcggcgcagggaccgatacttgtcatcagggatcgccacctcacacagtgccaagcccccgacgcacaaatatgtccggggagagaatggccctgggggcttcatcgtgctcaagtcggccagtaacccccgtgtttgcacctttgtctggattcttaatacagatctcaaggtggggtgctggggggctgccaggtgggttctgtggagtggaggggaccctgctgctgacttggttgctgcatgactttgggggctctctgccatgcctgggcctcccctttgtcagccacctttcttacttgaaaatttgggtcagggtccagatggtctcttagccctgggttgctgtagggcatgtgcccccccttcttacctctgagtcctgaggccctgaggaagggtggctggtggccagcccggccccaccctggtctgtttgtgtggctggtgccaagagccaggcccagcatgttcttcctgccaggggtgagtgggatgggtggcaggtgggggtgggctgctggccatgaatctctgcctctcccaggctgtccccctcctcccagggcctcctgggggacctttgtattaagccaattaaaaacatgaatttaaaaaaaaaaa

SEQ ID NO: 309383 - DNA, 1057 bp, Homo sapiens
cggactcagcggcggaagtggcgctgccggaagatcttcttccgctctgaggcgctactgaggccgcggagccggactgcggttggggcgggaagagccggggccgtggctgacatggagcagccctgctgctgaggccgcgccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaataccaacacaggcatccgtaagaacttggagcaggagatcatccagtacaactttaaaacttccttcttcgacatctttgtcctggccttcttccgcttctctggactgctcctaggctatgccgtgctgcagctccggcactggtgggtgattgcggtcacgacgctggtgtccagtgcattcctcattgtcaaggtcatcctctctgagctgctcagcaaaggggcatttggctacctgctccccatcgtctcttttgtcctcgcctggttggagacctggttccttgacttcaaagtcctaccccaggaagctgaagaggagcgatggtatcttgccgcccaggttgctgttgcccgtggacccctgctgttctccggtgctctgtccgagggacagttctattcacccccagaatcctttgcagggtctgacaatgaatcagatgaagaagttgctgggaagaaaagtttctctgctcaggagcgggagtacatccgccaggggaaggaggccacggcagtggtggaccagatcttggcccaggaagagaactggaagtttgagaagaataatgaatatggggacaccgtgtacaccattgaagttccctttcacggcaagacgtttatcctgaaggggggatcaactagagtcggcctgt

SEQ ID NO: 309384 - DNA, 270 bp, Homo sapiens
ccctccccgccctgaggtgggggcccaccaggatgagcaagctgcccagggagctgacccgagacttggagcgcagcctgcctgccgtggcctccctgggctcctcactgtcccacagccagagcctctcctcgcacctccttccgccgcctgagaagcgaagggccatctctgatgtccgccgcaccttctgtctcttcgtcaccttcgacctgctcttcatctccctgctctggatcatcgaactgaatgtgagtgggggcgaggtgg

SEQ ID NO: 309385 - DNA, 451 bp, Homo sapiens
ggccttcttccgcttctctggactgctcctaggctatgccgtgctgcagctccggcactggtgggtgattgcgcggtaagatgccactttcctggcagcttctgggccctggcagggctggtggaagggatgggatggaggaggactcacttcccagcctctgccttccccttcctccctccctcccctgggcaggtcacgacgctggtgtccagtgcattcctcattgtcaaggtcatcctctctgaggtcagtggctcagggtctggccagtctggtgggcatcagacctgagtggtatgcttctagagaggagcatttctctaatttggggtgtctgtccctgttgtccgggttagggggagagggaatcctgtcctttggtatctataaggaatcatccttcacccgcttccctgacttagccccttgcagctctaggaatcagaag

SEQ ID NO: 309386 - DNA, 610 bp, Homo sapiens
gatggaggaggactcacttcccagcctctgccttccccttcctccctccctcccctgggcaggtcacgacgctggtgtccagtgcattcctcattgtcaaggtcatcctctctgaggtcagtggctcagggtctggccagtctggtgggcatcagacctgagtggtatgcttctagagaggagcatttctctaatttggggtgtctgtccctgttgtccgggttagggggagagggaatcctgtcctttggtatctataaggaatcatccttcacccgcttccctgacttagccccttgcagctctaggaatcagaaggttctttctccagcctaaccccagtttatcctgctgcagacttgagagggttcccaagcagctgctaccaggaatggggtgtatgccagtttggctggctagagttggtagccacagaagggggctctgggtttggggtgacccctgccatggagctcagccccctcccttcacagctgctcagcaaaggggcatttggctacctgctccccatcgtctcttttgtcctcgcctggttggagacctggttccttgacttcaaagtcctaccccaggaagctgaagaggagcg

SEQ ID NO: 309387 - DNA, 234 bp, Homo sapiens
ctgggcagggcagggcagcctgtcacccgtgtgaagatgaaggggctcttcatctgcctgcgctctcgtcggtttttttaggattattgaaagagtctgggacccttgttggggagtgggtggcaggtgggggtgggctgctggccatgaatctctgcctctcccaggctgtccccctcctcccagggcctcctgggggacctttgtattaagccaattaaaaacatgaattta

SEQ ID NO: 309388 - DNA, 1874 bp, Homo sapiens
agcggcagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 309389 - DNA, 1828 bp, Homo sapiens
agcggcagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 309390 - DNA, 388 bp, Homo sapiens
ctctgccatgccccgcatcaaacccctgacgactacgatgacacagacgatgacgaccctttcaaccctcaggaatccaagcgctttgtgcagtggcagtcgtctatctgagcccctcctcccggctggactggagcctggctcccctcttcgctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 309391 - DNA, 2033 bp, Homo sapiens
agcggcagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcggagcttccaagggccaccccagctcctgcagccgggcctctgcccccctcccgccctccgagctgctccaggcatgggctgcgtgcctcctgctgggtggatcgcaccgggcaggccctccagcctgcatcactgccctgtctctccctctctccgcagttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 309392 - DNA, 2031 bp, Homo sapiens
agcggcagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagcagctgggtcctccttatttctcctctcccttgattcggcctcctggccagggctgggacatcctccctgctgtcctctctcccccggcctcccagctgccaggaatttctgcgcctgtccaggctcagcaaggggtccaaagacattgttcttta

SEQ ID NO: 309393 - DNA, 2008 bp, Homo sapiens
agcggcagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagccttgggggtggggaccaataatccccgtcttacccctcccataattcgaatctaatcttaaccctcttatcttaactttttaatattaacttatcaaaatactgttcttaatcttaacacaaacactatttttccatcatatataaccttcttattaaattttaatatcactccctaccccaattgctccctattattcaaatcttttacaattcactttccctccctttcaaaacttgtttcttgctaaacacctttgtttacccaacttaaactcactgttttgatattgcccttttttctatcttctttcattgtt

SEQ ID NO: 309394 - DNA, 1725 bp, Homo sapiens
agcggcagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 309395 - DNA, 1651 bp, Homo sapiens
agcggcagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 309396 - DNA, 2269 bp, Homo sapiens
agcggcagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggtggtaactcatcgatgcctcataacaatgctatgaagaaggaactatgattatcccacctaacaggttagaagatgaggagcagagttgagggaccttcccaaggtcacacggccagccagcccgtgcacactgaggagagagggaccttccggagggccccgccctctgccccccacagccaggcagttgcccagttttgtcctttctgcttctggaatgtcttcatccatctactctcaatgcccaatgcccctgccgcagctgaggcctcgttctctcccctgcagaaggaagcatggccccctccccatccatccccccatggaccctagaatagggctgccagattcagcaaacagcaaaccactctgctataagtacgcccggtgcaatgctggggagatacttatactagaaaattatgtattgggcatccgatactcaaatgtaactggaagtcctgaatttgatctggcaaccctacccaagagggatttgtctacgccatcgcatggatctgagctttccctggtctggctcagacagaccccttctgtggctcccactgcctcccacccttctggaactggcattccaaaaagggagtggggagtaagcactgaagccatgctcagaattgctgactattgagctgagaaaggctgggcccccacccagcccagggctgccctgatcttttgcataaggataaactggggttcaggcgcttttctgtggcctaggcagaaactgggctggaatacaggcccccagactcctttgtggagggagggaagggaaggaagaggacagatcactctacccttccctaccactgcaccatgagaccctgggtctccatctcccctgtcagtgtgccagggtcctcacagattaaaatcaagaataagcggcggggccgggcactgtggctcacgcctgtaatcccagcactttgggaaaccaaggtgggcggatcaccagaggtcaggagtttgagaccagcctggccagcatggcgaaatcccatctctactaaaaataca

SEQ ID NO: 309397 - DNA, 2012 bp, Homo sapiens
agcggcagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcagagcctcgcggttacacaacggccacctccaacaacgccgctccaccggctccggcctcggcccagactcacgcccgctctggcccggagacctcccgaagccgcacgcggggatccgcggccccagtcaccgccagaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 309398 - DNA, 1762 bp, Homo sapiens
agcggcagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 309399 - DNA, 1220 bp, Homo sapiens
taacactatttcacagaggacctgggctgtggcccagacacagtaaacagcaggaggctgagcttggagggtggtgaatgtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 309400 - DNA, 1019 bp, Homo sapiens
tgtttgtccgactctgggctccatggcctggaggcagccacgccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaa

SEQ ID NO: 309401 - DNA, 932 bp, Homo sapiens
  misc_feature (917)..(917): n is a, c, g, or t
aaaattttagtccttgaatgtgctcatatagcccataaggcaaatattttttaaactttattgtccctgatattaaccagaattggttgaatagtagaggaaaagggatttttaaaactgaaaatatgaacaaaatgagccttagaattgaatggattattttaaacaaattaatactcatataaaatgttttgctgcttctcaaagagtctgatacagggtaatttcatacaatatttgatgttgttaaagcattcctttttatagctgagcctttggagcttgttatgaacagtaaaatcatttagtcacatggttgtaaccttagtgcaaagtaaaaagggaaaagttgacctaatagaaacaatagtagtattgataagaacaaaagtcatcctccctgcctctcagaggccctgaagtcctgtgaggaagggaaatagtaatttaaccaaagttaaatctgtgtaactcatttattacaattttgaaaggcttgtcttagaagcattaaaggagtattagctaaaaacaaactaaattcctagagatgacaatcattgtagtcctctgtgaaactgaaaatgatcacatgaaaaaaatgtgagcataaaaaagagaagtaaaggtgtaccattagcctacatactgagctgacgatcagatcatagaatactttatttaatcaagacatttaaaaatacttatttcatctacatactttcaaagcaaaataatttctggggctagtttcctttgtataaggcttaagcaaggaatatatttccatgccctttgatccaagtaaaatctaaggaagagggaaagtaaaccttgaaattaagacctagaaatagatccacccttgcagactgataaaagtgggcaatctagtaggccagttcacattacagttnatctcagttttgctt

SEQ ID NO: 309402 - DNA, 404 bp, Homo sapiens
atgatcccgccaggtgaacgaatgccaggagcacagccgttgcaaatgttcgtggagttggggaaagccttggcggccatgctggtcagcatgcatggggcccagctggtcaccaccctcttcctgccccgtggggcaactgtggtagagctcttcccatatgctgtcaatcccgaccactacacgttaggtctacctggccaggtagacctaacccaggtagaccaacccaggtgcctctccacatctaaccttggccagagcttcagggtgggttggctagaaaaaccatctaccatgtatcagcgtgtgtgtgtgtgtgtgtgagtgtgcgtgctgtgctgtgtgtgtgcacagcgcagtgtcacatcagtatcagtgcctgcctgagttaggtcacctgg

SEQ ID NO: 309403 - DNA, 2512 bp, Homo sapiens
gcgcacggcgggcacctgcgagcctggaggtggcggtcgctgcgaacccggcggcgcggccaaacctgtgctggctgcctgggccttctgggcctcctgggccagaagctggcgctgggggcggcggcggggtgggaaagcggcgccgccgtggggcctcctggacgcgtcggcggaggtggcttcgtcccgcggagtccaggcttcaggctttcaccagttctcaggatgcccatagggatgggtgaagcctgcctggcctgtggtgctttccagtggccgtcatctcattagggccccacagtggcattaggatgcacctctcggcggtgttcaacgccctcctggtgtcggtgctggcagcggtcctgtggaagcatgtgcggctgcgtgagcatgcagccacactggaggaggagctggccctcagccgacaggccacagagccagccccagcactgaggatcgactacccgaaggcactgcagatcctgatggagggcggcacacacatggtgtgcacgggccgcacgcacacagaccgcatctgccgcttcaagtggctctgctactccaacgaggctgaggagttcatcttcttccatggcaacacctctgtcatgctgcccaacctgggctcccggcgcttccagccagccctgctcgacctatccaccgtggaggaccacaacactcagtacttcaacttcgtggagctgcctgctgctgccctgcgcttcatgcccaagccggtgttcgtgccagacgtggccctcatcgccaaccgcttcaaccccgacaacctcatgcacgtctttcatgacgacctgctgccactcttctacaccctgcggcagtttcccggcctggcccacgaggcacggctcttcttcatggagggctggggcgagggtgcacacttcgacctctacaagctgctcagccccaagcagcctctcctgcgggcacagctgaagaccctgggccggctgctgtgcttctcccatgcttttgtgggcctctccaagatcactacctggtaccagtatggctttgtgcagccccagggcccgaaggccaacatcctcgtctcaggcaatgagatccggcagtttgcacggttcatgacagaaaagctgaacgtgagccacacaggagtccccctaggcgaggagtacattctggtctttagccgaacccagaacagactcattctgaatgaggcagagctgctgctggcactggcccaggagttccagatgaagacagtgacagtgtccctggaggaccacacctttgctgatgtcgtgcggctggtcagcaatgcctccatgctggtcagcatgcatggggcccagctggtcaccaccctcttcctgccccgtggggcaactgtggtagagctcttcccatatgctgtcaatcccgaccactacactccctataagacgctggccatgctgcctggcatggacctccagtatgtagcctggcggaacatgatgccagagaacacagtcacacaccctgagcggccctgggatcaggggggcatcacccatctggaccgggctgagcaagcccgtatcctgcaaagccgtgaggtcccacggcatctctgttgccggaaccccgagtggctcttccgaatctaccaggacaccaaggtggacatcccatccctcattcaaaccatacggcgcgtggtgaagggccggccaggaccacggaagcagaagtggacagtcggcctatatccaggcaaggtgcgggaggcacggtgccaggcgtcagtgcatggcgcctccgaggcccgcctcactgtctcctggcagatcccatggaaccttaaatacctgaaggtgagggaggtgaagtacgaggtgtggctgcaggagcagggggagaacacctacgtgccttacatcctggctctgcagaaccacaccttcactgagaacatcaagcccttcaccacctacctggtgtgggtccgctgcatcttcaacaagatcctcctgggaccctttgcagatgtgctggtgtgcaacacgtagcgagcaggccacagcctggcctcgggaaggtggctcctgcagttcagcgtccctgggcccattaatcccactgtggagacttctgggaactatttattgagcaggcctgtgcctccacatcatcttgttgtctctggggtgtggtgtcacagcactcctctttgccctagagataagggacctgacttccccttctcccatcctgaacatttgtacccctggagaagttccttagcagggaggaggaagaggagaggaggaagcaaagaatcacaaggaacctctggctaggtgatcctgatgtttcctactgagtttttctggtatccagatttctggaaaccgagtaatcatgtactgtttgattgggtggttcatctgcttccatcccagtgaaatttacctgtagcccagtgaagggtgtgtttggaacattcattaaatgattctaagca

SEQ ID NO: 309404 - DNA, 1657 bp, Homo sapiens
gcgcacggcgggcacctgcgagcctggaggtggcggtcgctgcgaacccggcggcgcggccaaacctgtgctggctgcctgggccttctgggcctcctgggccagaagctggcgctgggggcggcggcggggtgggaaagcggcgccgccgtggggcctcctggacgcgtcggcggaggtggcttcgtcccgcggagtccaggcttcaggctttcaccagttctcaggatgcccatagggatgggtgaagcctgcctggcctgtggtgctttccagtggccgtcatctcattagggccccacagtggcattaggatgcacctctcggcggtgttcaacgccctcctggtgtcggtgctggcagcggtcctgtggaagcatgtgcggctgcgtgagcatgcagccacactggaggaggagctggccctcagccgacaggccacagagccagccccagcactgaggatcgactacccgaaggcactgcagatcctgatggagggcggcacacacatggtgtgcacgggccgcacgcacacagaccgcatctgccgcttcaagtggctctgctactccaacgaggctgaggagttcatcttcttccatggcaacacctctgtcatgctgcccaacctgggctcccggcgcttccagccagccctgctcgacctatccaccgtggaggaccacaacactcagtacttcaacttcgtggagctgcctgctgctgccctgcgcttcatgcccaagccggtgttcgtgccagacgtggccctcatcgccaaccgcttcaaccccgacaacctcatgcacgtctttcatgacgacctgctgccactcttctacaccctgcggcagtttcccggcctggcccacgaggcacggctcttcttcatggagggctggggcgagggtgcacacttcgacctctacaagctgctcagccccaagcagcctctcctgcgggcacagctgaagaccctgggccggctgctgtgcttctcccatgcttttgtgggcctctccaagatcactacctggtaccagtatggctttgtgcagccccagggcccgaaggccaacatcctcgtctcaggcaatgagatccggcagtttgcacggttcatgacagaaaagctgaacgtgagccacacaggagtccccctaggcgaggagtacattctggtctttagccgaacccagaacagactcattctgaatgaggcagagctgctgctggcactggcccaggagttccagatgaagacagtgacagtgtccctggaggaccacacctttgctgatgtcgtgcggctggtcagcaatgcctccatgctggtcagcatgcatggggcccagctggtcaccaccctcttcctgccccgtggggcaactgtggtagagctcttcccatatgctgtcaatcccgaccactacacgttaggtctacctggccaggtagacctaacccaggtagaccaacccaggtgcctctccacatctaaccttggccagagcttcagggtgggttggctagaaaaaccatctaccatgtatcagcgtgtgtgtgtgtgtgtgtgagtgtgcgtgctgtgctgtgtgtgtgcacagcgcagtgtcacatcagtatcagtgcctgcctgagttaggtcacctgg

SEQ ID NO: 309405 - DNA, 459 bp, Homo sapiens
ggtggagccgtgagtgagggcgtttgaagagcacttgtctttctcctgcctcagcagcacggacgggttccttggcggttggggatttgggtggatcctttctctgtagaagtattagtaacattggcatattggggttgaaaaaattaatctattgattcagcagattgaggtcttactttgtgctagacacggcggtaggtgttcggaaaatcagcagaaaacgtgaagacttggcttctagcccccgaacggttctctctggtgcataaggcaataaatgaacatataaagtagatgtagactggcaagtgctgtgaagaaggataatgtgtgtctgtgtgtgtgtctttttttagattggacggtgaaggaaggcttctgaggagataacatttaaaacctaaagaatgacaggcggggcgtgatggctcacgcctgtagtcccaacactttggg

SEQ ID NO: 309406 - DNA, 886 bp, Homo sapiens
ggctgcatccgggtgtctggaggctgtggccgtttgttttcttggctaaaatcggggtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacaaaaaaaaaaaaaatataatttacaaataaaaaaaccggggtttttttgggggggggaaaaaaggtataaagggcgggttatggttttggccctttttgaaggggaaggggccctaatggaggttaataaaagaggtctta

SEQ ID NO: 309407 - DNA, 777 bp, Homo sapiens
aggtggaggttgcggtgagccaagatcacaccactgcactccaggctcggcaaaaaacagagttttttgaaactctgtctcaaaaaaaatatatatataaatatactgtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaac

SEQ ID NO: 309408 - DNA, 2583 bp, Homo sapiens
agtagaaacttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccattgagttgctccgttgctgcccccctttttccttttctaggttgacctctccttgcccctaagcatggtaataacagttgcatgtattgagtgcttaccaaatggcaagcattgtgctgattcccatgcctacacgatctcatttcttccttaccacatccctgtaagtaaggtgaaatgccagagacctagacggggtggaaggagcaagtgactgctgggatttgcaccaggtctgcctaactcccagatcactatgatttgccctggtgttgcattggcctggtattcttggttctcctttctaaccctcagttcttggaggacaagatacctggtgatttaaaatattattttagtcttgggaaactaatttcaatttattagtttttcattattctaagacttcttcctttgtataaacttacttgcagatggttgaaagatagcttgaatttaatgaaatagaattcagtgtgccaggagttaggttcataccaggtggggatttcagtttcagcaagttggcatcatttttatagggtaggacagttctttgttacagagacataacgatactgtactctccacattattttaaatattagttgcctttgtaaacagtttcccctcccccacccctttttcgataattttagtaggtacaaaaaggttgatagtaacctgtatttatttcaaagatgctaatttgtatgtgaattgattatgtatgtagtagctttttaccttttagaacttaagacattagatgtgtggctatgtcaacaataataatcaaagctaacacattttgagctagacagtattctaggccctttatgattgttgagcattaatcctcaaaatgaccctgtaaaatagttaatattatccccatttgacagacgaaaaaatagaggcacagtgaagtaacttgcctaagaccacacaggagtaagtagcagtgctggtatttgaaccaggcatcctggctccagagcccattcttttaatcagagagacagagaataatgctggactacctgggtaaaatttgccacacacccagcctgaagttctaaaagaaaaagctaaaaaatatggttaaaaactgtatatacaacacagtttaatctctctgcttcatatttcacatctgaaaagtggcgttggaaataatacctctttcactaggtgagaattaaatgacttaatgtgtattaaagggcttacatgggtattagctaatgcagtagtatgattgttttattagcatatgcattatccatatagctttggtttatattttccatagagcctaaactttatagatcactatctaaatgaaaatttacatcaaactagtgttttaatatgacagttctagtgttgtttaagtctaagtgaagatttagggcatcttcctgggttttgggatttgtgcagtgtggcttctgaccagctgcatagacatggctccaggtaacagtccctgggactgagcagtggcccatgttggctgttggagctttcttttccctcatttgttatgagtcaataaagaagcagaaggtttggacgtgctagccagtgggaaagggaacctgagatggagctctctgatcaccctttcagccccagggcccggctctgtgtgagaagtctgtcccaaaattctgggacggaccacctcactgaccagctgaccagctgaccaggtctgtgtgttggtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacaaaaaaaaaaaaaatataatttacaaataaaaaaaccggggtttttttgggggggggaaaaaaggtataaagggcgggttatggttttggccctttttgaaggggaaggggccctaatggaggttaataaaagaggtctta

SEQ ID NO: 309409 - DNA, 864 bp, Homo sapiens
ggtggagccgtgagtgagggcgtttgaagagcacttgtctttctcctgcctcagcagcacggacgggttccttggcggttggggatttggttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacaaaaaaaaaaaaaatataatttacaaataaaaaaaccggggtttttttgggggggggaaaaaaggtataaagggcgggttatggttttggccctttttgaaggggaaggggccctaatggaggttaataaaagaggtctta

SEQ ID NO: 309410 - DNA, 868 bp, Homo sapiens
tagagtgtgtgtgtgtgtgtgtgtgtgtgtgtgtgtgtgtgtgttgatgattgtgggaagggttctgagtcctatgaaattatgcttctcttttttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacaaaaaaaaaaaaaatataatttacaaataaaaaaaccggggtttttttgggggggggaaaaaaggtataaagggcgggttatggttttggccctttttgaaggggaaggggccctaatggaggttaataaaagaggtctta

SEQ ID NO: 309411 - DNA, 829 bp, Homo sapiens
  misc_feature (791)..(791): n is a, c, g, or t
  misc_feature (793)..(793): n is a, c, g, or t
aggtggaggttgcggtgagccaagatcacaccactgcactccaggctcggcaaaaaacagagttttttgaaactctgtctcaaaaaaaatatatatataaatatactgtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacaaaaaaacacaccnanaccagaaaaaacgacaccctcaccagccacacgccc

SEQ ID NO: 309412 - DNA, 2423 bp, Homo sapiens
agtagaaacttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccattgagttgctccgttgctgcccccctttttccttttctaggttgacctctccttgcccctaagcatggtaataacagttgcatgtattgagtgcttaccaaatggcaagcattgtgctgattcccatgcctacacgatctcatttcttccttaccacatccctgtaagtaaggtgaaatgccagagacctagacggggtggaaggagcaagtgactgctgggatttgcaccaggtctgcctaactcccagatcactatgatttgccctggtgttgcattggcctggtattcttggttctcctttctaaccctcagttcttggaggacaagatacctggtgatttaaaatattattttagtcttgggaaactaatttcaatttattagtttttcattattctaagacttcttcctttgtataaacttacttgcagatggttgaaagatagcttgaatttaatgaaatagaattcagtgtgccaggagttaggttcataccaggtggggatttcagtttcagcaagttggcatcatttttatagggtaggacagttctttgttacagagacataacgatactgtactctccacattattttaaatattagttgcctttgtaaacagtttcccctcccccacccctttttcgataattttagtaggtacaaaaaggttgatagtaacctgtatttatttcaaagatgctaatttgtatgtgaattgattatgtatgtagtagctttttaccttttagaacttaagacattagatgtgtggctatgtcaacaataataatcaaagctaacacattttgagctagacagtattctaggccctttatgattgttgagcattaatcctcaaaatgaccctgtaaaatagttaatattatccccatttgacagacgaaaaaatagaggcacagtgaagtaacttgcctaagaccacacaggagtaagtagcagtgctggtatttgaaccaggcatcctggctccagagcccattcttttaatcagagagacagagaataatgctggactacctgggtaaaatttgccacacacccagcctgaagttctaaaagaaaaagctaaaaaatatggttaaaaactgtatatacaacacagtttaatctctctgcttcatatttcacatctgaaaagtggcgttggaaataatacctctttcactaggtgagaattaaatgacttaatgtgtattaaagggcttacatgggtattagctaatgcagtagtatgattgttttattagcatatgcattatccatatagctttggtttatattttccatagagcctaaactttatagatcactatctaaatgaaaatttacatcaaactagtgttttaatatgacagttctagtgttgtttaagtctaagtgaagatttagggcatcttcctgggttttgggatttgtgcagtgtggcttctgaccagctgcatagacatggctccaggtaacagtccctgggactgagcagtggcccatgttggctgttggagctttcttttccctcatttgttatgagtcaataaagaagcagaaggtttggacgtgctagccagtgggaaagggaacctgagatggagctctctgatcaccctttcagccccagggcccggctctgtgtgagaagtctgtcccaaaattctgggacggaccacctcactgaccagctgaccagctgaccaggtctgtgtgttggtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaac

SEQ ID NO: 309413 - DNA, 561 bp, Homo sapiens
taaaattatgcatatccagtgaaccaggggatagtccaaaatcttactgacgtcctgctggctctgcactgataatccggtatgatgtggtcctgactggcaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacaaaaaaaaaaaaaatataatttacaaataaaaaaaccggggtttttttgggggggggaaaaaaggtataaagggcgggttatggttttggccctttttgaaggggaaggggccctaatggaggttaataaaagaggtctta

SEQ ID NO: 309414 - DNA, 857 bp, Homo sapiens
gcggccgcctactactactactactactaaattcccggccgctcgaccgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacaaaaaaaaaaaaaatataatttacaaataaaaaaaccggggtttttttgggggggggaaaaaaggtataaagggcgggttatggttttggccctttttgaaggggaaggggccctaatggaggttaataaaagaggtctta

SEQ ID NO: 309415 - DNA, 937 bp, Homo sapiens
aggtggaggttgcggtgagccaagatcacaccactgcactccaggctcggcaaaaaacagagttttttgaaactctgtctcaaaaaaaatatatatataaatatactgtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacaaaaaaaaaaaaaatataatttacaaataaaaaaaccggggtttttttgggggggggaaaaaaggtataaagggcgggttatggttttggccctttttgaaggggaaggggccctaatggaggttaataaaagaggtctta

SEQ ID NO: 309416 - DNA, 1107 bp, Homo sapiens
aggtggaggttgcggtgagccaagatcacaccactgcactccaggctcggcaaaaaacagagttttttgaaactctgtctcaaaaaaaatatatatataaatatactgtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacaaaaaaaaaaaaaaaaaaaaccaagggtatctgccgcgggggagcacacggctagtaaacggacaaggttcataacgtgtcctgggaccgtttctcgtcccaaggcgcgaatcgggcggcccctaaaggagccaataatccgaaacccggtacggtacaatcgcgcaacgagacaaacaaggggacaaaagacaaagaacccagcacgaaacaagaaccaaagaagacaacaacgtaaaaggtaaagacaaaacagaaagaaagagagcacagcaacaaagaaaaagaaaaaacagaaaacaaaaaaagaa

SEQ ID NO: 309417 - DNA, 893 bp, Homo sapiens
aggtggaggttgcggtgagccaagatcacaccactgcactccaggctcggcaaaaaacagagttttttgaaactctgtctcaaaaaaaatatatatataaatatactgtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaagttccgctggcacccaggtgcccatgtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacaaaaaaaaaaaaaatataatttacaaataaaaaaaccggggtttttttgggggggggaaaaaaggtataaagggcgggttatggttttggccctttttgaaggggaaggggccctaatggaggttaataaaagaggtctta

SEQ ID NO: 309418 - DNA, 534 bp, Homo sapiens
tctagctcggtacccttttttcagacagagtctcactctggttacctaggctggagtgcagtggtgtgatctgggctcactgcagcctcaacctgggtgacagaacaagagccgggctttaaatgatttttattttaaaaaaaaaaaaaaaaaaaaaattcagatcccagcacatgtcattttttctattagcattatactagttcaaacctacattatcttttgcctagattttcctcttaagagtctgttgagtctatttctagtagtcacttaactagttacttgtaactagatatctaactgcctcctaactagttcttacccataaaagtctatagtgcctatagcaaacagtcagattatgttacttttatggtcagatgcctccaaaggcttctaaactgattaagaataaaagatgaaggccttataatgggctgagagactctacatgatatcctgctttccagtcattccacatcgacattatcttctattaccctcttacttggcctttttgctgttccttga

SEQ ID NO: 309419 - DNA, 705 bp, Homo sapiens
gaggatcccccctgagtccatcacttctttctggtaagtatgttcaaatgttaacatgcttgctcattttggtcttctttgaagactaccttatctaaaattgacctcttccctcctctgtcaacattttctatcatctatcaccaaatatcactctacttgctttgtctcttatttcttttttaaaataaaaatcatttaaagactggctcttgttctgtcacccaggttgaggctgcagtgagcccagatcacaccactgcactccagcctaggtaaccagagtgagactctgtctggaaaaaaaaaaaaaaaaaaaaaaaaaaaaattcagatcccagcacatgtcattttttctattagcattatactagttcaaacctacattatcttttgcctagattttcctcttaagagtctgttgagtctatttctagtagtcacttaactagttacttgtaactagatatctaactgcctcctaactagttcttacccataaaagtctatagtgcctatagcaaacagtcagattatgttacttttatggtcagatgcctccaaaggcttctaaactgattaagaataaaagatgaaggccttataatgggctgagagactctacatgatatcctgctttccagtcattccacatcgacattatcttctattaccctcttacttggcctttttgctgttccttga

SEQ ID NO: 309420 - DNA, 2089 bp, Homo sapiens
atgttagagtacccagcagatgtgaaggaaaatatataagcttagtgaaattttgactggtcacttaattgttcattgggaaatgaaagaggtctagaatatgttgaagtttattacagacaaaaataaaaatgaaggggaatctaaatgcattaacattttgtaccttttaatattatagtttttttcttcctctgttccaaagttttccagatactgtagcctgctttttactatgttgataaagaggaggtgtctgagaagctttgtagaaataatgtgggaacatggagaagaactgaattgaggtcagggaagctataaacctttgagtgcttttgtgatgtgatgtgctctatgggaggctgtgtatgagttcaagcttgagaaacttgcttgataaaaatgtgactattaacacttactgttccttcctcttgttaagagtctcttgagaagatgaatttttatttaaatactgttttgtcttttttttttttcctggttataaaatgcttacagatattttgtccttagagttatacctatccctcacaaataacctgaaacataaatataataacagagtatgtcacaaagataggaaattcctggtgattccagagaaactggaatctctagtttgtaaggaaaatagtctctatctttggcttctttggcttgtaaagtgcttggtattatacagattgtccccagtttgttgactcctattatgacttgaacctgctctagaaaggcttttgcccccattactccaaggaaactgcagtgatcaaggttgcaaattacctcgtctttttaaaatcaagcatcattttccagtcttcattttactgggcttatcagcagcatttaatatggttaatcaccttcttttccttcaagtactttgtttattttgcatcctaggacattatgctcacttggtttttctcgtatctgtctttcttgcctctccttggaaggttttcctcatatctacaatcctttaagggctaatttcttggacgtcttttctagctacgctcttgttcttggtcacatctattcctataacctttaataccatctatatgctggagacttctatatctatgtccttgtttggatctctcccctaaatctcagactcttgttgaaacagcttattcattgtctctatttggatgtctaataggcatctcagacttaatatgtccgcagctgagttcctgatactaacctgttctgccttgagtcttcattatccagtaaatagcaactccatccttctagtttaggtcccttgcagtcatcctggactcctttctctcacatcccatatccaaactgtcaagaaagtcttgttggttctatctataaaacatattcagatcccaggcggggcgtggtggctcaacgcctgtaatctcagcactcggggaggccaaggcgggtacattgcttgagtctaggagttcaagaccagcctgggcaacatggcaaaactctgtctactaaaaatacaaaaaattagctaggcgtggtggcacgcacctgtagacccagctacttgggaggctgaggtgggagaatcgcctgagcctgggaggttgaggctgcagtgagcccagatcacaccactgcactccagcctaggtaaccagagtgagactctgtctggaaaaaaaaaaaaaaaaaaaaaaaaaaaaattcagatcccagcacatgtcattttttctattagcattatactagttcaaacctacattatcttttgcctagattttcctcttaagagtctgttgagtctatttctagtagtcacttaactagttacttgtaactagatatctaactgcctcctaactagttcttacccataaaagtctatagtgcctatagcaaacagtcagattatgttacttttatggtcagatgcctccaaaggcttctaaactgattaagaataaaagatgaaggccttataatgggctgagagactctacatgatatcctgctttccagtcattccacatcgacattatcttctattaccctcttacttggcctttttgctgttccttga

SEQ ID NO: 309421 - DNA, 1510 bp, Homo sapiens
atgttagagtacccagcagatgtgaaggaaaatatataagcttagtgaaattttgactggtcacttaattgttcattgggaaatgaaagaggtctagaatatgttgaagtttattacagacaaaaataaaaatgaaggggaatctaaatgcattaacattttgtaccttttaatattatagtttttttcttcctctgttccaaagttttccagatactgtagcctgctttttactatgttgataaagaggaggtgtctgagaagctttgtagaaataatgtgggaacatggagaagaactgaattgaggtcagggaagctataaacctttgagtgcttttgtgatgtgatgtgctctatgggaggctgtgtatgagttcaagcttgagaaacttgcttgataaaaatgtgactattaacacttactgttccttcctcttgttaagagtctcttgagaagatgaatttttatttaaatactgttttgtcttttttttttttcctggttataaaatgcttacagatattttgtccttagagttatacctatccctcacaaataacctgaaacataaatataataacagagtatgtcacaaagataggaaattcctggtgattccagagaaactggaatctctagtttgtaaggaaaatagtctctatctttggcttctttggcttgtaaagtgcttggtattatacagattgtccccagtttgttgactcctattatgacttgaacctgctctagaaaggcttttgcccccattactccaaggaaactgcagtgatcaaggttgcaaattacctcgtctttttaaaatcaagcatcattttccagtcttcattttactgggcttatcagcagcatttaatatggttaatcaccttcttttccttcaagtactttgtttattttgcatcctaggacattatgctcacttggtttttctcgtatctgtctttcttgcctctccttggaaggttttcctcatatctacaatcctttaagggctaatttcttggacgtcttttctagctacgctcttgttcttggtcacatctattcctataacctttaataccatctatatgctggagacttctatatctatgtccttgtttggatctctcccctaaatctcagactcttgttgaaacagcttattcattgtctctatttggatgtctaataggcatctcagacttaatatgtccgcagctgagttcctgatactaacctgttctgccttgagtcttcattatccagtaaatagcaactccatccttctagtttaggtcccttgcagtcatcctggactcctttctctcacatcccatatgtacaaaaaataattaactgcatgtggtggtacacgtgtgtagtatcagctacttgggaggctgaggtgggaggatcacttgagtgccagaggtcgaaactgcagtgagccatgatctcacccttgcactccagcctcagcatcaaagcgagaccctgtctcaaa

SEQ ID NO: 309422 - DNA, 2159 bp, Homo sapiens
ctttccgtccccttgcttcgtcttcgcttttctttctacttattcttatctgtgtctttcgctttgtttgcctctccgtctgttttccctcagggcccccttctttcctcgaccttttcaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctgggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcagttttctgcttaactctatatcttatgtgattctgatattacaataaaattatggggtaaactttaaaaattctgcttaaatttgtattttgtgaaattttgatactaagtgataaatatgatggtatacttgagaaagttttctaggaaaaatattttctgcatagtcttttaagaaaaatatatgggggccaggcgcagtggctcacgcctgtaatcctagtgctttgggaggccaaggcgggtggatcacctgaggtcaggagttcgagaccagcctagccaaggtagcaaaaccctatctctgctaaaaaaaaaaatacaaaaattagctgggcatggtggcgggcgcctgtaatcccagcttctcgggaggctgaggcagggagaatcacttgaacctgggaggcg

SEQ ID NO: 309423 - DNA, 452 bp, Homo sapiens
aaaattcagtccatcagctatgctagccacaattcaagtgttcaattgggcagtgcagatatagaacttttctatcatgacattactagacagtgttggtctggagacttaatagttcatttattataatgcatgaaatttaaatgttttttaattttaaagagaaaacaaagggaataacttgcttttaagctattggatagtgttacaataatatttttaaatgaattgtgttgaattttgctacagtagtcgttttgtgtttgtacctggtccagaggatcctggatttggttccatcttaccaaggccaccacttgctgaaagcatcactaatgaattcagacaaagggtaccattttcagtttttactactaatccttgcaggtaagaattagtattttgtgttatacatttttcctttcatttaaaaattagccaggtgtggtggc

SEQ ID NO: 309424 - DNA, 1866 bp, Homo sapiens
ctttccgtccccttgcttcgtcttcgcttttctttctacttattcttatctgtgtctttcgctttgtttgcctctccgtctgttttccctcagggcccccttctttcctcgaccttttcaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctgggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcagttttctgcttaactctatatcttatgtgattctgatattacaataaaattatggcctcgttggcctcagcggtggagctctgcggccgacattttttttataacaccccccaacatg

SEQ ID NO: 309425 - DNA, 1267 bp, Homo sapiens
cccgcctcggcctcccaaagtactgggattacaggcgtgagccaccgtgcccggccgtttagtcagttttaagacacagatatagcctattattttatttactgcttccatattgcttatcttgttttagaatatttagataacctttgtacttttaaagtgttacaaagagtacctttttacactggaaaataacttcattagatacaaagaagctaaatgtatacaactattagaaaaatatctctagtggtatatagaagataattatgttataattatctagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctgggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcagttttctgcttaactctatatcttatgtgattctgatattacaataaaattatggcctcgttggcctcagcggtggagctctgcggccgacattttttttataacaccccccaacatg

SEQ ID NO: 309426 - DNA, 1823 bp, Homo sapiens
  misc_feature (1804)..(1804): n is a, c, g, or t
  misc_feature (1806)..(1806): n is a, c, g, or t
ctttccgtccccttgcttcgtcttcgcttttctttctacttattcttatctgtgtctttcgctttgtttgcctctccgtctgttttccctcagggcccccttctttcctcgaccttttcaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctgggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcagttttctgcttaactctatatcttatgtgattctgatattacaataaaattatggncntggcctcgttggcctca

SEQ ID NO: 309427 - DNA, 1875 bp, Homo sapiens
ctttccgtccccttgcttcgtcttcgcttttctttctacttattcttatctgtgtctttcgctttgtttgcctctccgtctgttttccctcagggcccccttctttcctcgaccttttcaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctgggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcagttttctgcttaactctatatcttatgtgattctgatattacaataaaattatggaattcatcagttttctgcttaactctatatcttatgtgattctgatattacaataaaattatggtaaacttt

SEQ ID NO: 309428 - DNA, 2882 bp, Homo sapiens
ctttccgtccccttgcttcgtcttcgcttttctttctacttattcttatctgtgtctttcgctttgtttgcctctccgtctgttttccctcagggcccccttctttcctcgaccttttcaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctgggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagataggtaagtgtgtgcacagacacagcaagaaagatctttctctaggtgttaaattactgaaaatgagatgttctatcagtgtgttgggatttttgaaaatgtctacagtggcccataaagaaatattattggctgagcttatcacggttatgctgtgtgacacagaattgtgggtacatgacggtacgtttgtgttgaaatagatcaagaactgttttctgggggaaatctcaggccagctgtggaggtgagctagttctcttacaggccaactcctgacgatggtctcactcttctgagaggtcagtcctgccctccgtacggttgcttcttaggtactttcccttaaattgacagtgagggagctgtgtgtgagtttggtgatggtatggggttggagttacggaaaggtcttgagaaagaagaaaataatcacctagtgggtagtagttttcacagggtgatctacatagatcacccacatcagaatcctctggggtccttgttaaaaatgttaagttaggattttgccccagactcatcaaatgactttctaattgtaaagaataggcattttaaatattatttcctgtaatttcaggcatcctaacatgtgatttctcagataactgtattttgaaaaagttcccaccactggttaagaacaagtgcccaggcagggcacggtggctcatgcctgtaatcccaggactttgggaggccgagcaaacttcaaggcttttgagattcttaaagatcatctgaagaaaattcatcagttttctgcttaactctatatcttatgtgattctgatattacaataaaattatggggtaaactttaaaaattctgcttaaatttgtattttgtgaaattttgatactaagtgataaatatgatggtatacttgagaaagttttctaggaaaaatattttctgcatagtcttttaagaaaaatatatgggggccaggcgcagtggctcacgcctgtaatcctagtgctttgggaggccaaggcgggtggatcacctgaggtcaggagttcgagaccagcctagccaaggtagcaaaaccctatctctgctaaaaaaaaaaatacaaaaattagctgggcatggtggcgggcgcctgtaatcccagcttctcgggaggctgaggcagggagaatcacttgaacctgggaggcg

SEQ ID NO: 309429 - DNA, 2284 bp, Homo sapiens
ctttccgtccccttgcttcgtcttcgcttttctttctacttattcttatctgtgtctttcgctttgtttgcctctccgtctgttttccctcagggcccccttctttcctcgaccttttcaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctgggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagataggcatcctaacatgtgatttctcagataactgtattttgaaaaagttcccaccactggttaagaacaagtgcccaggcagggcacggtggctcatgcctgtaatcccaggactttgggaggccgagcaaacttcaaggcttttgagattcttaaagatcatctgaagaaaattcatcagttttctgcttaactctatatcttatgtgattctgatattacaataaaattatggggtaaactttaaaaattctgcttaaatttgtattttgtgaaattttgatactaagtgataaatatgatggtatacttgagaaagttttctaggaaaaatattttctgcatagtcttttaagaaaaatatatgggggccaggcgcagtggctcacgcctgtaatcctagtgctttgggaggccaaggcgggtggatcacctgaggtcaggagttcgagaccagcctagccaaggtagcaaaaccctatctctgctaaaaaaaaaaatacaaaaattagctgggcatggtggcgggcgcctgtaatcccagcttctcgggaggctgaggcagggagaatcacttgaacctgggaggcg

SEQ ID NO: 309430 - DNA, 1965 bp, Homo sapiens
ctttccgtccccttgcttcgtcttcgcttttctttctacttattcttatctgtgtctttcgctttgtttgcctctccgtctgttttccctcagggcccccttctttcctcgaccttttcaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctgggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagatcaagaactgttttctgggggaaatctcaggccagctgtggaggtgagctagttctcttacaggccaactcctgacgatggtctcactcttctgagagcaaacttcaaggcttttgagattcttaaagatcatctgaagaaaattcatcagttttctgcttaactctatatcttatgtgattctgatattacaataaaattatggcctcgttggcctcagcggtggagctctgcggccgacattttttttataacaccccccaacatg

SEQ ID NO: 309431 - DNA, 1839 bp, Homo sapiens
ctttccgtccccttgcttcgtcttcgcttttctttctacttattcttatctgtgtctttcgctttgtttgcctctccgtctgttttccctcagggcccccttctttcctcgaccttttcaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctgggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcacccttacgcaaaaataataaataatataaaggaataaaaataaaacaataaaattctgccctcgttgccctcagcggtgagctctcggctg

SEQ ID NO: 309432 - DNA, 1385 bp, Homo sapiens
agtgagaccatgtctcaaaaaaaaaataaataaataaaataaaaaataaaaaatatacatattgtgtttaaaaaaatttattttaaaaaaaagtctgagcattcacttacaggcatttttctcccccaaagggctcttttccaagaagtggattttcattcaaagttttttatccttctaataagacagtagaagataggtaagtgtgtgcacagacacagcaagaaagatctttctctaggtgttaaattactgaaaatgagatgttctatcagtgtgttgggatttttgaaaatgtctacagtggcccataaagaaatattattggctgagcttatcacggttatgctgtgtgacacagaattgtgggtacatgacggtacgtttgtgttgaaatagatcaagaactgttttctgggggaaatctcaggccagctgtggaggtgagctagttctcttacaggccaactcctgacgatggtctcactcttctgagaggtcagtcctgccctccgtacggttgcttcttaggtactttcccttaaattgacagtgagggagctgtgtgtgagtttggtgatggtatggggttggagttacggaaaggtcttgagaaagaagaaaataatcacctagtgggtagtagttttcacagggtgatctacatagatcacccacatcagaatcctctggggtccttgttaaaaatgttaagttaggattttgccccagactcatcaaatgactttctaattgtaaagaataggcattttaaatattatttcctgtaatttcaggcatcctaacatgtgatttctcagataactgtattttgaaaaagttcccaccactggttaagaacaagtgcccaggcagggcacggtggctcatgcctgtaatcccaggactttgggaggccgagcaaacttcaaggcttttgagattcttaaagatcatctgaagaaaattcatcagttttctgcttaactctatatcttatgtgattctgatattacaataaaattatggggtaaactttaaaaattctgcttaaatttgtattttgtgaaattttgatactaagtgataaatatgatggtatacttgagaaagttttctaggaaaaatattttctgcatagtcttttaagaaaaatatatgggggccaggcgcagtggctcacgcctgtaatcctagtgctttgggaggccaaggcgggtggatcacctgaggtcaggagttcgagaccagcctagccaaggtagcaaaaccctatctctgctaaaaaaaaaaatacaaaaattagctgggcatggtggcgggcgcctgtaatcccagcttctcgggaggctgaggcagggagaatcacttgaacctgggaggcg

SEQ ID NO: 309433 - DNA, 555 bp, Homo sapiens
ctttccgtccccttgcttcgtcttcgcttttctttctacttattcttatctgtgtctttcgctttgtttgcctctccgtctgttttccctcagggcccccttctttcctcgaccttttcaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatgtatgtgggtacagttaacttttttcctccttggaggtgttattgagcacttatttttaattattgtcttggaaaattattagtgatcaacgtttctacagtgattactgttgttatttctgtgtgtctttttaaataatggctttctttgcaaacctcattattaaatgactcatcttt

SEQ ID NO: 309434 - DNA, 226 bp, Homo sapiens
  misc_feature (38)..(38): n is a, c, g, or t
atggcaaatcgtctcgactcctattcctacaaccccgnacccccttacggctaccgcaaacttcaaggcttttgagattcttaaagatcatctgaagaaaattcatcagttttctgcttaactctatatcttatgtgattctgatattacaataaaattatggcctcgttggcctcagcggtggagctctgcggccgacattttttttataacaccccccaacatg

SEQ ID NO: 309435 - DNA, 293 bp, Homo sapiens
attactagatatttgtatgttaaattatgtgggttttcaaatttgtggagaataagtaatagtgacattagtttaaggacagtgtttcatcagggcactattttaatgaatcttatatttaaatgtctgtttcaggaattcatgtgaatctttcttttttatagaggacccacaggcatgaattatttactcctccggtgataggttctcaccctgatgaaagcggaagcaaattccaggttagaacattatcctagttatgtagggggtataagtgtgtaagtttaatattt

SEQ ID NO: 309436 - DNA, 489 bp, Homo sapiens
tagaggattagacaaatgaaagtgacgttactttttttcaggttggtttgaagatcaagtgtttcatgtcaatgcctttggatttccacccactgagccctctagtactactaggtattaaaatgtttggtttatactctatgggaatttggtaatactggcaggagtgaatgtaagatagtacgtcatatctcagttactaaaaggtgtcaggctttgtgtcaaaatggaaaaagcaatggaaaatgagaattagaagactgggttttgtatgtaatgtgaaaactagcagattggccaacaattagttgcaataccgtctttgtacttcggctttaactgggaaagatttccagtctgttttatctctggggttgatgagaagttgaagtgagataagacaactaggataacacttagaagaatataattccatgttaatataaaattctcatttttatattccaatgaatgaaagttatgtgaggt

SEQ ID NO: 309437 - DNA, 338 bp, Homo sapiens
cctctcgaaaaaaaaaaaaaaaaaaaaagacatacatttgctttttgggagcagaaaagggggcatgagaatgacttattttttagagtctccttttgaatttgaaacagtatgtatgtattgacctgtttttaaaaatcaattaactatacctatttaaaaaaattaactacaactattagtaagtatacaacttaggtttccaaatatttaatttttttttctattttcagcaaacttcaaggcttttgagattcttaaagatcatctgaagaaaattcatcagttttctgcttaactctatatcttatgtgattctgatattacaataaaattat

SEQ ID NO: 309438 - DNA, 5343 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaaaaaaaaaatgct

SEQ ID NO: 309439 - DNA, 896 bp, Homo sapiens
ccacctcagccttccaagtagctgggatttataggcacaggtgtgtgccaccgtgcctggctgtggagggttcttcagaggcagagccctgggttggtttgaatccttcatgctttgtgctgctaccttggttcacttagtacagagggcagggggagtggaaagggagaagtgagatgatttgggggcttcctgggacctgtgtactaagttgataggggctcgttttcaatcctgtgttgtgtgcctccacaggaattgaggcatcggacctgtccagtctgctggagcagtttgagaaatcagaagccaaaaaggagtgtcctcctccggctcctgctgacagcttggctgtaggaaactcagggtaagtatggagacatgagcgagttaccctacagctgttagtcagcagccggctgacactccaggactgtcaactggatgcctctgttgcagggacgctgtagtcagctctagagtctttccctgtttccccaccccttactctgcctatcactaccgggcagtgtcttgggtggtgaggtgagaacggggcatgttcactgccctccagctgattccagtcgggctccaaatgtcctagaggtgccttttatctcctggcaagtcatacctttggggatttctttctttcatttaataacacttcaagtttgctcagtgctggtaatggtgtaacttaaagtggaggaagatgttaatggctaggagtcatttttcatgttcatgatcctccatcctgttctgccaagcatgttcccctccacattgatttcaggttggtgtgagctgggcaggtgagactcgatgtgaaggaggtggggggtattcaaggtcatggccagcctgcctcttggaattgggcagggctc

SEQ ID NO: 309440 - DNA, 1134 bp, Homo sapiens
atctttttttctcagtaaccaagttttcccacttaatgaagaattcttgggttttggagatgatatatgtcttcagaactggcccatactacaagtctagcagttaacctctctcatggtcacagtatttcagtgagacctggtaggggagcaatagtaacccaaaagacccaggcttggccccagcaccacagatagctgggtgtgagacctagggctcacccctctccctgagtctccatttattgttcttcctctttctgatttgttaaatatttttcaatttttaagtgcacaattgaaaatgtgatctcttccaaaacacttcacaacattccaggtacacctaaagttccatgaagggcctcagtttgttcatctctgaatgaaaattgttcttctagacctcttctactctgctttgtctttggtcctgagcttcctaaaagaaaggcaggactggggcctgggtgagataagcagagtatacctgaaccactcccagcattcctgcatgccctcttatccttcaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaatgaagtgagaagctaccatctccggggcaaagacaaagggccaaaaattcattcccaccctcacccccagcagacaaaaaaacaccatgggacattaaataaaacagaaatcactgaaaccacagagaaaaaatttattatcaattcgtcagaaatccactctcaaggttaaaagaagagatggggttttcccaaggcactctggtgtgaagtgaaaaaaatgacagaccagggaagatttagtctccttgatgaggttcaccatggaagacgtaaaagctgtatcccgaagaagggaatacaaggcaagagcaaaaccagaaaacgcaatcatcaggcaaaagcgaggccttgagtgaccactatgaggcagaaga

SEQ ID NO: 309441 - DNA, 407 bp, Homo sapiens
gaaatggggactggggactctcctatctctttgacttaaaattagagcagttttcactccatccgtttttgggatgggagatagctagccatttgcagaccctgtggttgggaagtgtggtcagagaccttgaagtttgtctttacctttatagactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatca

SEQ ID NO: 309442 - DNA, 809 bp, Homo sapiens
ccacctcagccttccaagtagctgggatttataggcacaggtgtgtgccaccgtgcctggctgtggagggttcttcagaggcagagccctgggttggtttgaatccttcatgctttgtgctgctaccttggttcacttagtacagagggcagggggagtggaaagggagaagtgagatgatttgggggcttcctgggacctgtgtactaagttgataggggctcgttttcaatcctgtgttgtgtgcctccacaggaattgaggcatcggacctgtccagtctgctggagcagtttgagaaatcagaaggtgagggaacatgggtagttttgctccaactctttttttggtgatacttttttgggcccagccctgtagttgcttaaactagggtgagaggggacacccttagccactggagcagacccctaattggaagagagagacaagattgaactgtgacggtaatccaagccagggacggcagtgatacagtaaggaaggtattaaagagtagactgggaatccaggccaggcgtggtggctcatgcctgtaatcccagcactctgggaagctgaggcgggtggatcatgaggtcaggagtttgagaccagcctggccaacatggtgaaaccccgtatctactaaaaatacaaaaattagctgggcgaggtggcgggcacctgtaatcccagttactcgggaggctgaggcaggagaattgtttgaacccagcaggcagagattgcagtgagccgagatcgtgccattgcactctagcctgggccacagggtgagactctgtctc

SEQ ID NO: 309443 - DNA, 5496 bp, Homo sapiens
tttggtgtgcccctcagactgttatcttcactgctgccagtagatgattctgaacaatcttgattttcctgatgtttgtactcccgggttttaatctgtgactctagctgtttctggttggagcccaaacatttttctgccccagaaggtccctgaaaactgccatccttattggggtttttgctcataggttgtgcttctctctgctctgctagcccagaagtttggcgacagtgttgctgctgctgagtttggccccagcagtggagggtacctgatttatggagcatattatcagctgctgccagagagctcatacccttctcaccttcttctctgctccaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaaaaaaaaaatgct

SEQ ID NO: 309444 - DNA, 3476 bp, Homo sapiens
ggggtgacacaagcagctccgaatcaggaatgctgtcaaatggagaaaggttctcagaatctgcattgtccaagatctccgtcagagccgtgagcagcgacacttcattctggtcctccagagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaaaaaaaaaatgct

SEQ ID NO: 309445 - DNA, 5183 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatca

SEQ ID NO: 309446 - DNA, 5211 bp, Homo sapiens
  misc_feature (5186)..(5186): n is a, c, g, or t
  misc_feature (5190)..(5190): n is a, c, g, or t
  misc_feature (5193)..(5193): n is a, c, g, or t
  misc_feature (5196)..(5196): n is a, c, g, or t
  misc_feature (5201)..(5201): n is a, c, g, or t
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcaaanaaanaanaanacaanacacaagggg

SEQ ID NO: 309447 - DNA, 4333 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatca

SEQ ID NO: 309448 - DNA, 4551 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcagggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaaaaaaaaaatgct

SEQ ID NO: 309449 - DNA, 5329 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttggtgagtggagggagggcctaaagctttggaatgcttcatcccctccccagaagggttcctaaccctttgtgagtggggctaggcagacttaccttagtttgacatacaaagaacccaagggggctgggcatggtggctcacgcctgtaatcccagcactttgggaggctgaggcaggcaaatcacgaggtcaggagttcgagaccagcctggccaacatgatgaaaccccatctctaccaaaaatagaaaaaattagctagaggtggtggcacgcacctgtaatcccagctactcgggaagctgaggcaggagaattgcttgaacccaggaggcggaggttgcagtgagctgacatcacaacactgcactccagcctgggctacagaacgagactgtct

SEQ ID NO: 309450 - DNA, 5020 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgacgtgcgatcgcggcaatactctatctctgcacctatcggagaacctatgtgatctgtctctgatcgagatcactagcggctgaggtatg

SEQ ID NO: 309451 - DNA, 5040 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcaggcggcgttgacattccccaggagaagaggcccctagaccggttacaagccccagaactggccaacgtggcagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaatgaagtgagaagctaccatctccggggcaaagacaaagggccaaaaattcattcccaccctcacccccagcagacaaaaaaacaccatgggacattaaataaaacagaaatcactgaaaccacagagaaaaaatttattatcaattcgtcagaaatccactctcaaggttaaaagaagagatggggttttcccaaggcactctggtgtgaagtgaaaaaaatgacagaccagggaagatttagtctccttgatgaggttcaccatggaagacgtaaaagctgtatcccgaagaagggaatacaaggcaagagcaaaaccagaaaacgcaatcatcaggcaaaagcgaggccttgagtgaccactatgaggcagaaga

SEQ ID NO: 309452 - DNA, 1437 bp, Homo sapiens
atctttttttctcagtaaccaagttttcccacttaatgaagaattcttgggttttggagatgatatatgtcttcagaactggcccatactacaagtctagcagttaacctctctcatggtcacagtatttcagtgagacctggtaggggagcaatagtaacccaaaagacccaggcttggccccagcaccacagatagctgggtgtgagacctagggctcacccctctccctgagtctccatttattgttcttcctctttctgatttgttaaatatttttcaatttttaagtgcacaattgaaaatgtgatctcttccaaaacacttcacaacattccaggtacacctaaagttccatgaagggcctcagtttgttcatctctgaatgaaaattgttcttctagacctcttctactctgctttgtctttggtcctgagcttcctaaaagaaaggcaggactggggcctgggtgagataagcagagtatacctgaaccactcccagcattcctgcatgccctcttatccttcaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaaaaaaaaaatgct

SEQ ID NO: 309453 - DNA, 848 bp, Homo sapiens
tcagggagcgctatgcacctgggatgcaggtgcctaagagttgagtcttgaattgtcttatgtttggggggctgatgacaccctcttttgtcaggtacagctcttatcgttcacatgaccattaccaaaggcaaagagtgctacaaaaggagcgtgcaatagaagaaagaagggtggtcttcattggaaagatacctggccgcatgactcgatcagagctgaaacagaggttctccgtttttggagagattgaggagtgcaccatccacttccgtgtccaaggggacaactacggcttcgtcacttatcgctatgctgaggaggcatttgcagccattgagagtggccacaagctgcggcaggcagatgagcagccctttgatctctgctttgggggccgaaggcagttctgcaagaggagctattctgatcttgactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaaaaaaaaaatgct

SEQ ID NO: 309454 - DNA, 4331 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcagggtaagtatggagacatgagcgagttaccctacagctgttagtcagcagccggctgacactccaggactgtcaactggatgcctctgttgcagggacgctgtagtcagctctagagtctttccctgtttccccaccccttactctgcctatcactaccgggcagtgtcttgggtggtgaggtgagaacggggcatgttcactgccctccagctgattccagtcgggctccaaatgtcctagaggtgccttttatctcctggcaagtcatacctttggggatttctttctttcatttaataacacttcaagtttgctcagtgctggtaatggtgtaacttaaagtggaggaagatgttaatggctaggagtcatttttcatgttcatgatcctccatcctgttctgccaagcatgttcccctacccgggatacagatcccggggagggattaagctgtatttattgtttgctgtagctgtaggtgtcagaggctaatatttcttctggtgcccttgtgttagtctcccctggtgtcattggggctccctagtgagttcttaaataagatcttcggtgtgcaattttaaccattgtattcctggtatgttactaggaaccctactgaagagttcttcatgtaagcagaacacaatatgttatatgtactgtcgcgaagactactttc

SEQ ID NO: 309455 - DNA, 4176 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaagccaaaaaggagtgtcctcctccggctcctgctgacagcttggctgtaggaaactcagggtaagtatggagacatgagcgagttaccctacagctgttagtcagcagccggctgacactccaggactgtcaactggatgcctctgttgcagggacgctgtagtcagctctagagtctttccctgtttccccaccccttactctgcctatcactaccgggcagtgtcttgggtggtgaggtgagaacggggcatgttcactgccctccagctgattccagtcgggctccaaatgtcctagaggtgccttttatctcctggcaagtcatacctttggggatttctttctttcatttaataacacttcaagtttgctcagtgctggtaatggtgtaacttaaagtggaggaagatgttaatggctaggagtcatttttcatgttcatgatcctccatcctgttctgccaagcatgttcccctccacattgatttcaggttggtgtgagctgggcaggtgagactcgatgtgaaggaggtggggggtattcaaggtcatggccagcctgcctcttggaattgggcagggctc

SEQ ID NO: 309456 - DNA, 4089 bp, Homo sapiens
gccagcgatcagagcagcgctgggtgttcaggggccaagatggcggcgcgccggggacggagagacggagtcgcgccgcccccgagtgggggccccggtccggaccctggcgggggagcccgcggcagtggttggggaagtcgaagccaagcgccgtatgggactttgggcgctgtgagcggcggcgagcaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctctgcacaagctgcttactctctctcggacacccccagaacgtgacctcatcaccccagttgacccactggggcccagtacaggcagcagtagagggagtggggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggaattgaggcatcggacctgtccagtctgctggagcagtttgagaaatcagaaggtgagggaacatgggtagttttgctccaactctttttttggtgatacttttttgggcccagccctgtagttgcttaaactagggtgagaggggacacccttagccactggagcagacccctaattggaagagagagacaagattgaactgtgacggtaatccaagccagggacggcagtgatacagtaaggaaggtattaaagagtagactgggaatccaggccaggcgtggtggctcatgcctgtaatcccagcactctgggaagctgaggcgggtggatcatgaggtcaggagtttgagaccagcctggccaacatggtgaaaccccgtatctactaaaaatacaaaaattagctgggcgaggtggcgggcacctgtaatcccagttactcgggaggctgaggcaggagaattgtttgaacccagcaggcagagattgcagtgagccgagatcgtgccattgcactctagcctgggccacagggtgagactctgtctc

SEQ ID NO: 309457 - DNA, 374 bp, Homo sapiens
ggaaagatacctggccgcatgactcgatcagagctgaaacagaggttctccgtttttggagagattgaggagtgcaccatccacttccgtgtccaagggtaagcttgggccccaggctcaggatgttctttctatcccattcatctaccttggtgtttctttgtcttgcctccttgctctggtgtgctgagcaatatggggcaccttcatttctgcagtcagagggttggccactgggaatgagaagaaccacctctgtaccttgggatgctgtgtctcctctatggcatgggcccatatagccactccagcccctgcctcactctcctcctactagggacaactacggcttcgtcacttatcgctatgctgag

SEQ ID NO: 309458 - DNA, 436 bp, Homo sapiens
ttttttttttccccccctttttttaaaaaacagggaaaacgggttcccccaattttctgtggttttgggttaaaaaccctaaaaaaaaaagggttggtttccaccaaaatttttttaggaaaatcccctttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaa

SEQ ID NO: 309459 - DNA, 2503 bp, Homo sapiens
cattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttacctttttttttttttttttttggagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtgtatttggctaaaaaattatactgccaaaattactgattataaatactttgactacactgattgatggggacaaaatgattaaagtattttcagggatcttattccatatgtcaccaccaaagatttctacagtgttataaagtatataaatattccaaatttctgtggttaaatatttttttcttttttttccttttttagaataacacagtctgtgctttccaaaaatgcttgaacttttatgttgttaagaaatatataatgatatcttacattaagcatgagtctaatttgtattaattgggatggactaaattttcatttgattatcaggaaaattaaggagttatatatttaaaagcaattttctgtgttttcttctttgtaagttgactcatttgtgaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaa

SEQ ID NO: 309460 - DNA, 2465 bp, Homo sapiens
cattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttacctttttttttttttttttttggagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtgtatttggctaaaaaattatactgccaaaattactgattataaatactttgactacactgattgatggggacaaaatgattaaagtattttcagggatcttattccatatgtcaccaccaaagatttctacagtgttataaagtatataaatattccaaatttctgtggttaaatatttttttcttttttttccttttttagaataacacagtctgtgctttccaaaaatgcttgaacttttatgttgttaagaaatatataatgatatcttacattaagcatgagtctaatttgtattaattgggatggactaaattttcatttgattatcaggaaaattaaggagttatatatttaaaagcaattttctgtgttttcttctttgtaagttgactcatttgtgaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaa

SEQ ID NO: 309461 - DNA, 2998 bp, Homo sapiens
cattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttacctttttttttttttttttttggagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtgtatttggctaaaaaattatactgccaaaattactgattataaatactttgactacactgattgatggggacaaaatgattaaagtattttcagggatcttattccatatgtcaccaccaaagatttctacagtgttataaagtatataaatattccaaatttctgtggttaaatatttttttcttttttttccttttttagaataacacagtctgtgctttccaaaaatgcttgaacttttatgttgttaagaaatatataatgatatcttacattaagcatgagtctaatttgtattaattgggatggactaaattttcatttgattatcaggaaaattaaggagttatatatttaaaagcaattttctgtgttttcttctttgtaagttgactcatttgtgaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaaaaaaaaaaaaaaaaaaaaaaaaaaaaaaaaaaaaaaaaaaaaaaaaaaaaagggggggggcgaacaaaaaagactctccacgggggggacacaacataacaacggcacaccgaaagattatgtattacaaaaaggagggaccactaaataggggactctataaaaacaagcagagagagggacggaggatatagaaaacaatggtaggagagagaacaaccgtacggagtgaggggcgattccgggaaggaagaagcaccacacaactgtgggggggggtcggaacacaaagtgggagggacaacaacacccccgacgagggagattagaaacagaggcccagcggggagcaagaaactacaacacaagcagaggttgatagtcgtggggagtaaacaacgatgggcatacaacatgacgtacgaacagcagaagttggcaataggagaattgatgatgaacaagatatttaaggaggaggtgtaacacaagggg

SEQ ID NO: 309462 - DNA, 2377 bp, Homo sapiens
cattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttacctttttttttttttttttttggagacggagtcttgctctgtcaccaggctggagtgcagtggcgcgatctcggctcactacaacctctgcctcccgggttcgagcgattctcctgccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtgtatttggctaaaaaattatactgccaaaattactgattataaatactttgactacactgattgatggggacaaaatgattaaagtattttcagggatcttattccatatgtcaccaccaaagatttctacagtgttataaagtatataaatattccaaatttctgtggttaaatatttttttcttttttttccttttttagaataacacagtctgtgctttccaaaaatgcttgaacttttatgttgttaagaaatatataatgatatcttacattaagcatgagtctaatttgtattaattgggatggactaaattttcatttgattatcaggaaaattaaggagttatatatttaaaagcaattttctgtgttttcttctttgtaagttgactcatttgtgaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaa

SEQ ID NO: 309463 - DNA, 2457 bp, Homo sapiens
cattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttacctttttttttttttttttttggagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaatttgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtgtatttggctaaaaaattatactgccaaaattactgattataaatactttgactacactgattgatggggacaaaatgattaaagtattttcagggatcttattccatatgtcaccaccaaagatttctacagtgttataaagtatataaatattccaaatttctgtggttaaatatttttttcttttttttccttttttagaataacacagtctgtgctttccaaaaatgcttgaacttttatgttgttaagaaatatataatgatatcttacattaagcatgagtctaatttgtattaattgggatggactaaattttcatttgattatcaggaaaattaaggagttatatatttaaaagcaattttctgtgttttcttctttgtaagttgactcatttgtgaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaa

SEQ ID NO: 309464 - DNA, 3047 bp, Homo sapiens
cattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttacctttttttttttttttttttggagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagtttgtttaggagtaagaattgacccattcgttagtttaccatattttttcctggtataaaaaggagccagaaataagccttattgctaaataattaattatgtaagcccacctaggtcctgcataagatccccctcacatacttcacaatatatatgtgtgtgtgtgtgtgtgtgtgtgtgtgtgtgtgtgtgtgtgtgtatttggctaaaaaattatactgccaaaattactgattataaatactttgactacactgattgatggggacaaaatgattaaagtattttcagggatcttattccatatgtcaccaccaaagatttctacagtgttataaagtatataaatattccaaatttctgtggttaaatatttttttcttttttttccttttttagaataacacagtctgtgctttccaaaaatgcttgaacttttatgttgttaagaaatatataatgatatcttacattaagcatgagtctaatttgtattaattgggatggactaaattttcatttgattatcaggaaaattaaggagttatatatttaaaagcaattttctgtgttttcttctttgtaagttgactcatttgtgaagcaattaggcaaattttgagaagatcattgttattgtggtttgcagtatatatttcttagtaaatatcacttaagattaaatttttcagaaagaaaattatagcttttttcccaaaatatttttaagatttaatctttttgtagtatgctacagatttaattatattaactcttttttaagacattgaccatgacttaacattttgccttctaacaccttttaaatctatgtactttaatagttaagagaaaataagtttgcagatttttaataatctgtttgtaaaaggctatctctaagcctagtatgtgggtaattttacaggtgtgttttttgataactttaatataaaataaactcattttatttgtggcaattcgcgtttctttttttatgccagagtacatatgttggattccatgaattggtattacttattattatgtgttgattaaatatatgcacacacttaggattacagatcacagagcaaattatgaaaatcataaacattctggtatggtcatccataggattatgaaaaagaaatactgaattgttaaatttggatgttagaaaggaaagataggaaaaacaatgagtacagaaatcctcaccatcaatttggatgggttagctgtctcaggcataaaatgtaacacaaaattcagatttatgtatcctggaaatgttctggggttccatctgttttaaagttagacgtctgtctgcctcacatttaagctttagagagaaatcctatgttttaagaagtttctttgtgttacttcattatgacacataatgcgtgttaaggtctttctagatagcattttaaatggaattattttcattttcattatgaggtatatacttgtaatgatctaaagaggttagaaatataaataaaaattcaaaag

SEQ ID NO: 309465 - DNA, 1859 bp, Homo sapiens
cattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttacctttttttttttttttttttggagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaattagcctgtacatttttgtttcttttaaggtagaacagatctttttttgtttctccttttaagtctactggttttaaaagaggtaaatgtatccatagaccacagtgccttgctttttcctctgccagcacatggagcacgggattagatgcacaaacctatttagggaactattttggtagatgtttgagtttatacagaaattgcagctggtattttattttgctgtacatttactcaacttgtccattagtatttaactatttccagagggaagagagcaaggtctgctgctgctgccccgggctccgaggccagcttcacagagtccagagggctgcagaataagaacagagggggggccaatgggaaagggaggcggggcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaa

SEQ ID NO: 309466 - DNA, 1294 bp, Homo sapiens
cattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttacctttttttttttttttttttggagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttccctatcttctctattcttttcttcgccttcccgtacttctgtcttccagttttccacttcaaacttctatcttctccaaattgtttcatccgtcgacgcggccgcgaat

SEQ ID NO: 309467 - DNA, 1079 bp, Homo sapiens
acgcgcgcggccgtttccggaggcggtggccaaagtgggcggggctaggccggagctgctggtgggaggcagccacttgagatcaccaggcctcctgtagaccggcgggtgcagggcccggtcccagagttaagggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagcaaaagaagtaaactgtggatatttaatatattcataaagatggagaatttcccacttgagtgtattctattctgaattttggaaccaagctagctgattttacacgtttgattttatgattacatatggaaaaaaatcaaaaccgcaatgttacaggtctctcacacctttcactgtacttctgtaataaagggaattagaataatttattggttaaataaggtaactataaaccaatttttaacaaatttgattttgagttacgatgattgcgtattccaggtacaacttaaattgctgtaactgttttgttaagttcttttttggataaaaaatcttctaaaatcttatttttctgaaatgtaaacttaccttatagtatatgcatcttaattaaactgttcttgatcgacttaaggt

SEQ ID NO: 309468 - DNA, 1184 bp, Homo sapiens
acgcgcgcggccgtttccggaggcggtggccaaagtgggcggggctaggccggagctgctggtgggaggcagccacttgagatcaccaggcctcctgtagaccggcgggtgcagggcccggtcccagagttaagggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagatttttctagatatgacatttggttcgggagggcacacaaaagccattctgcagaaggagtcagatattgttctctatgccttggacagagacccaacagcttatgcattagctgaacatctttcagagttgtatcctaaacaaatccgagctatgctgggccagttcagccaggcagaagccttattaatgaaagctggagtgcagccaggaacttttgatggagttcttatggatcttgggtgtcctccatgcaattgatactcctgaaagaggttttcccttcggaaagatggccttggacatgagaatggatgtgccagatcaacgcactgcatctatctaagactacggggggggaagctgccagaaatcgttggcattgttcggccgcgattaccattacagaaccaggtgcacgttcggcgtgctcttattctcccggttgaaaactttccgtgccgtgggctcccccgtgttgtttccccccgggatgtaacagaacccttgggttggtgcccccccc

SEQ ID NO: 309469 - DNA, 1118 bp, Homo sapiens
acgcgcgcggccgtttccggaggcggtggccaaagtgggcggggctaggccggagctgctggtgggaggcagccacttgagatcaccaggcctcctgtagaccggcgggtgcagggcccggtcccagagttaagggaaagtcgtttggaaaccccaggccaacaggaccctttggcagctgaggctggaaacagcggaaccaaaggcagacggtcctcagttgcttgggcggacgtggacccaatctgtccgtccttacaagtttcccccaggggcaggacctagacgcgcggcgcattcaggttctcctggaccgtagtggtagtcgctggcccgagttagaggccagctgagaagtcttcgtgcttcagatttgtttacctacaaaatgcttcggtatccatatttttgtagaatgtataaagaatgcctttcatgttggttggaatctggcatacctaatttaggtgtctggccaaacagaatacatactacagcagaaaaatatagagaatatgaagcccgggagcaaacagatcaaactcaagcccaggagttacacagatctcaagatagagattttgaaactatggctaaattacatattccagtaatggtggatgaagttgttcattgtttgtcaccacaaaaaggacagagtcttggtgtgaggagtgtgggaatatgaatcctacagcaaaagaagtaaactgtggatatttaatatattcataaagatggagaatttcccacttgagtgtattctattctgaattttggaaccaagctagctgattttacacgtttgattttatgattacatatggaaaaaaatcaaaaccgcaatgttacaggtctctcacacctttcactgtacttctgtaataaagggaattagaataatttattggttaaataaggtaactataaaccaatttttaacaaatttgattttgagttacgatgattgcgtattccaggtacaacttaaattgctgtaactgttttgttaagttcttttttggataaaaaatcttctaaaatcttatttttctgaaatgtaaacttaccttatagtatatgcatcttaattaaactgttcttgatcgacttaaggt

SEQ ID NO: 309470 - DNA, 1072 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309471 - DNA, 1020 bp, Homo sapiens
ggccggggggtgaatcggccgagggtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcactactgcaggggcagacgggactcatgccaatgggacccctgctggactcggggttctgtcacccacgtgtttaaagtcttggcccccaatatggaaatcgaggtaagagagaagaacactaaaaagggatatactaggcacccactaaggtccagaatacgggaacaaagagtaacgtcgcaaaaa

SEQ ID NO: 309472 - DNA, 716 bp, Homo sapiens
  misc_feature (608)..(608): n is a, c, g, or t
  misc_feature (624)..(624): n is a, c, g, or t
  misc_feature (651)..(651): n is a, c, g, or t
  misc_feature (672)..(672): n is a, c, g, or t
  misc_feature (699)..(699): n is a, c, g, or t
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttggnaaacttactccggagngtcaagagggggagcacagtgtcaaangagaggaggcattgggggaangttaaaaaaagcgcccctttttggggnatcaggagtgattttgc

SEQ ID NO: 309473 - DNA, 975 bp, Homo sapiens
  misc_feature (114)..(114): n is a, c, g, or t
  misc_feature (116)..(116): n is a, c, g, or t
  misc_feature (118)..(118): n is a, c, g, or t
  misc_feature (120)..(120): n is a, c, g, or t
  misc_feature (127)..(127): n is a, c, g, or t
agcggcgcctttttcattagggagatagttggtattaggattaggattgtgtgaagtatagtacggatgcgtacttgtccaatgatggtaaaagggtagcttactggttgtccncngntncaggttnatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgggtaagatccttcgggagaccgaggaggggaaggggctgcagttctcgtttaggtgcctggctccatttctgggtagacgctattaggtcctcccttctgctttgctagatgtgagacttgaaaacacggaaacatgctgaggtgaggcagtctccgtgggtttttcagttgagggttcttttaccttccccctgccacacacatttttcttatgacctctggttgtatccagatagtctctaaccactaaatgttttaccttctccaaactgttacccagagagtg

SEQ ID NO: 309474 - DNA, 636 bp, Homo sapiens
  misc_feature (114)..(114): n is a, c, g, or t
  misc_feature (116)..(116): n is a, c, g, or t
  misc_feature (118)..(118): n is a, c, g, or t
  misc_feature (120)..(120): n is a, c, g, or t
  misc_feature (127)..(127): n is a, c, g, or t
agcggcgcctttttcattagggagatagttggtattaggattaggattgtgtgaagtatagtacggatgcgtacttgtccaatgatggtaaaagggtagcttactggttgtccncngntncaggttnatgtggaggtcagagtggaagcaggtgtgagagggtccagcagaaggaaacatggctgccaaagtgtttgagtccattggcaagtttggcctggccttagctgttgcaggaggcgtggtgaactctgccttatataatggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309475 - DNA, 478 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaaggggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309476 - DNA, 274 bp, Homo sapiens
  misc_feature (15)..(15): n is a, c, g, or t
  misc_feature (24)..(24): n is a, c, g, or t
  misc_feature (41)..(41): n is a, c, g, or t
  misc_feature (51)..(51): n is a, c, g, or t
  misc_feature (53)..(53): n is a, c, g, or t
  misc_feature (68)..(68): n is a, c, g, or t
ggcagtatgtgtggntggggaaancatttgttgttcagagnggaagcaggngngagagggggcagganatttaatcatgactgccaaagtggccccctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309477 - DNA, 1871 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttccggctcaaaaaaaagacacccacgcccacacaggaccataccacacgccgctcacgacaggagctttcccgcgcccc

SEQ ID NO: 309478 - DNA, 1502 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaaaaaaaaaaaaaaaaaaaaaaaaaaaaactgaaacaaaaaccaagataacaaaccaccaacatatcaacaacacaaaaaggggggggggggcggtaaaaaaatgccggggggcgcccaattatggggacactcatttttatatgaaagagcggcgcccctaagaagaggcgtataaaaagcgagggcaggcggtaaaaacaggctgggagggacaacagagtggctggggtaattgggagagaaccccctgccgtcgggtgtattaggaccaccacaccagatgatagagggcggggaacaaaacggtgttgtggtggcacccagctattgcgtgagaatgttgtttattttattaattatgtgtttgtgatagagaggaggaggaattttggtaggtagggtgggatggtagtagcagcggcatagaatc

SEQ ID NO: 309479 - DNA, 1076 bp, Homo sapiens
  misc_feature (42)..(42): n is a, c, g, or t
agagatctgaagtgattttacctttatttccttcactttaanccaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309480 - DNA, 1051 bp, Homo sapiens
taaggggggcaccatacggctaggtacgaggccgggtggtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309481 - DNA, 1167 bp, Homo sapiens
gcggggcagaggagctcatgcgcagtatgtgtggttggggaattcatgtggaggtcagagtggaagcaggtgagaatggagggggcggcaaaggctcgtttctgggcatctctgcagtcctcctctgctccatgatgtgcactttgggcgaggagagtgcgtgcgtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309482 - DNA, 1037 bp, Homo sapiens
ggccggggggtgaatcggccgagggtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309483 - DNA, 1156 bp, Homo sapiens
agcggctcttccccccgtcggactcagaccgtggctgcttgccacgaggcccgggggatgtggggcgtatgcatcgtgatcgagctgttgcttcataacacagcgctgtagtgctctaatacacgagtgttgacgagcagtatggatgaggaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309484 - DNA, 1154 bp, Homo sapiens
  misc_feature (114)..(114): n is a, c, g, or t
  misc_feature (116)..(116): n is a, c, g, or t
  misc_feature (118)..(118): n is a, c, g, or t
  misc_feature (120)..(120): n is a, c, g, or t
  misc_feature (127)..(127): n is a, c, g, or t
agcggcgcctttttcattagggagatagttggtattaggattaggattgtgtgaagtatagtacggatgcgtacttgtccaatgatggtaaaagggtagcttactggttgtccncngntncaggttnatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309485 - DNA, 1055 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcactactgcaggggcagacgggactcatgccaatgggacccctgctggactcggggttctgtcacccacgtgtttaaagtcttggcccccaatatggaaatcgaggtaagagagaagaacactaaaaagggatatactaggcacccactaaggtccagaatacgggaacaaagagtaacgtcgcaaaaa

SEQ ID NO: 309486 - DNA, 910 bp, Homo sapiens
tccgagggttacagtggataggtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309487 - DNA, 1149 bp, Homo sapiens
atgtctcgggggaaggcccggtggatgtcccgggaggtaagagggcttatgaaccatgttccaaacctttgcgttgcttttctttccatcgtgtctatttcataacatccctgtgaggctggatgtgggaacttcagcactgccgtactcttgggaaatttgtccaaggccacccggctgagcagcggttgaaccaggacaccatcaggcatgcgtttcttgtctccaccacaccctcaacccactccccgcgccgtccgctggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309488 - DNA, 842 bp, Homo sapiens
taaggggggcaccatacggctaggtacgaggccgggtggtggaagcagacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309489 - DNA, 1903 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtgtaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttccggctcaaaaaaaagacacccacgcccacacaggaccataccacacgccgctcacgacaggagctttcccgcgcccc

SEQ ID NO: 309490 - DNA, 1272 bp, Homo sapiens
gaggatttctattggatacgcggatacgggcagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttccggctcaaaaaaaagacacccacgcccacacaggaccataccacacgccgctcacgacaggagctttcccgcgcccc

SEQ ID NO: 309491 - DNA, 1425 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttccggctcaaaaaaaagacacccacgcccacacaggaccataccacacgccgctcacgacaggagctttcccgcgcccc

SEQ ID NO: 309492 - DNA, 981 bp, Homo sapiens
gcggggcagaggagctcatgcgcagtatgtgtggttggggaattcatgtggaggtcagagtggaagcagttatcttggccccaggatgtcatccagctcctgcttccataagaagcatgtcgttcttaatacacgatgttgacaagcagtatggtgaggaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcggaaagaggactggagagaatcgcggacacatctcagcccggacaaaacatacgggagggggagcgcgcaccgatgccacagggg

SEQ ID NO: 309493 - DNA, 967 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatttggaaccttccggggaagggagttcacacagacgcggcgggaagtccacatcaggtgggcctcgcgggaaccccagagggcccgactatgcggctggaccaccgctgcgccactggaacacaggcgcactcactctctccctgagcgggacctccggcactgacgacgacttgcaactccatgcccacgcccgggcatgctccagctctactctcacacgcgagtccagcaatcggaacacctagcgcactgacaacacatcacacagcggcgtctcctcgccacagggccacgcgcctccgcactgcccaccatcaccaacgcgcccaacgaaccacgccgagggtgccccac

SEQ ID NO: 309494 - DNA, 600 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagactgtcaacatcacactgcgcatcctaggaacggcggcaagaggcacagccagtggcggcagcaggggtgggcatccgggctaaggctttacttggcggtagtctcatcggattttgcagcttctgggcccccaagctgggcccgcgactcgaaggtgactgggatggtgatctcgttggactgcgtggctagcttgggcattgggggctccacggtcagtgtgccctcaggggacagggaggagg

SEQ ID NO: 309495 - DNA, 572 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309496 - DNA, 765 bp, Homo sapiens
  misc_feature (730)..(730): n is a, c, g, or t
  misc_feature (744)..(744): n is a, c, g, or t
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaagaagggcttgaagcaaacaagaaaaaaangggcgggccaatcnatctcctggcttgaaggggcc

SEQ ID NO: 309497 - DNA, 909 bp, Homo sapiens
  misc_feature (34)..(34): n is a, c, g, or t
gggctgttggaattcggcactaggtggaggtcanagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgatgaacgggcaagttgaagtgcaagaccttggtaccattttcagccttcggaataactactgccggggcacgggtccccactgcctgaggccccctcgccccggtatggcagcctgttttaagttttc

SEQ ID NO: 309498 - DNA, 977 bp, Homo sapiens
acttccagagaagctggttataaaaaaccagcaatttcacaaggagccaggctgtgcaaatctgggtggctgctctcgtgtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatttggaaccttccggggaagggagttcacacagacgcggcgggaagtccacatcaggtgggcctcgcgggaaccccagagggcccgactatgcggctggaccaccgctgcgccactggaacacaggcgcactcactctctccctgagcgggacctccggcactgacgacgacttgcaactccatgcccacgcccgggcatgctccagctctactctcacacgcgagtccagcaatcggaacacctagcgcactgacaacacatcacacagcggcgtctcctcgccacagggccacgcgcctccgcactgcccaccatcaccaacgcgcccaacgaaccacgccgagggtgccccac

SEQ ID NO: 309499 - DNA, 1925 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttccggctcaaaaaaaagacacccacgcccacacaggaccataccacacgccgctcacgacaggagctttcccgcgcccc

SEQ ID NO: 309500 - DNA, 1727 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgcccccctcgttcagagactgcccttctcacgggctctatgcctgcactgggaaggaaacaaatgtgtataaactgctgtcaataaatgacacccagaccttccggctcaaaaaaaagacacccacgcccacacaggaccataccacacgccgctcacgacaggagctttcccgcgcccc

SEQ ID NO: 309501 - DNA, 1090 bp, Homo sapiens
tactggtgcagcggttagcggttatgcgtacggccacgttcttggtgaggtgttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309502 - DNA, 1164 bp, Homo sapiens
gcggggcagaggagctcatgcgcagtatgtgtggttggggaattcatgtggaggtcagagtggaagcagttatcttggccccaggatgtcatccagctcctgcttccataagaagcatgtcgttcttaatacacgatgttgacaagcagtatggtgaggaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309503 - DNA, 1040 bp, Homo sapiens
  misc_feature (18)..(18): n is a, c, g, or t
  misc_feature (20)..(20): n is a, c, g, or t
aatagctagtagaggctngngtgaatcggccgaggaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309504 - DNA, 1030 bp, Homo sapiens
gaacaggggctagggagcaggggatatgtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309505 - DNA, 1032 bp, Homo sapiens
acgcgtccgcggacgcgtgggggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309506 - DNA, 933 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgatgaacgggcaagttgaagtgcaagaccttggtaccattttcagccttcggaataactactgccggggcacgggtccccactgcctgaggccccctcgccccggtatggcagcctgttttaagttttc

SEQ ID NO: 309507 - DNA, 1012 bp, Homo sapiens
  misc_feature (3)..(3): n is a, c, g, or t
tgntttcttactggatgtgtgtccgggcatttcatgtggcggtcagagtggaatcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaa

SEQ ID NO: 309508 - DNA, 1353 bp, Homo sapiens
gtgtgtagttgttctagaggatccctgaggtagaacacatctgaccttcgggaaggagttcacagaagcggtggaagccaaacaggtggctcagcaggaagcagagagggccagatttgtggtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttccggctcaaaaaaaagacacccacgcccacacaggaccataccacacgccgctcacgacaggagctttcccgcgcccc

SEQ ID NO: 309509 - DNA, 1397 bp, Homo sapiens
ccagtgttggtttgagtttgtttctttactgaattcatgggcctgttgaattttagtggagcggacccgctcccctcacatccgtactggcccggaatgctgcgagagccaggaagtctcctccgctgtggccacatccgtactggcccgcgggccagtacggatgtggaaaaggctgagcaacagaaaaaggcggccatcatctctgctgagggcgactccaaggcagctgagctgattgccaactcactggccactgcaggggatggcctgatcgagctgcgcaagctggaagctgcagaggacatcgcgtaccagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttccggctcaaaaaaaagacacccacgcccacacaggaccataccacacgccgctcacgacaggagctttcccgcgcccc

SEQ ID NO: 309510 - DNA, 1393 bp, Homo sapiens
  misc_feature (19)..(19): n is a, c, g, or t
  misc_feature (23)..(23): n is a, c, g, or t
  misc_feature (25)..(25): n is a, c, g, or t
ctcgtgcaatttcggcagnggtncnacgaggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagctctcacgctctcggaacatcacctacctgccagcggggcagtccgtgctcctccagctgccccagtgagggcccaccctgcctgcacctccgcgggctgactgggccacagccccgatgattcttaacacagccttccttctgctcccaccccagaaatcactgtgaaatttcatgattggcttaaagtgaaggaaataaaggtaaaatcacttcagatctctaattagtctatcaaatgaaactctttcattcttctcacatccatctacttttttatccacctccctaccaaaaattgccaagtgcctatgcaaaccagctttaggtcccaattcggggcctgctggagttccggcctgggcaccagcatttggcagcacgcaggcggggcagtatgtgatggactggggagcacaggtgtctgcctagatccacgtgtggcctccgtcctgtcactgatggaaggtttgcggatgagggcatgtgcggctgaactgagaaggcaggcctccgtcttcccagcggttcctgtgcagatgctgctgaagagaggtgccggggaggggcagagaggaagtggtctgtctgttaccataagtctgattctctttaactgtgtgaccagcggaaacaggtgtgtgtgaactgggcacagattgaagaatctgcccctgttgaggtgggtgggcctgactgttgccccccagggtcctaaaacttggatggacttgtatagtgagagaggaggcctggaccgagatgtgagtcctgttgaagacttcctctctaccccccaccttggtccctctcagatacccagtggaattccaacttgaaggattgcatcctgctggggctgaacatgcctgccaaagacgtgtccgacctacgttcctggccccctcgttcagagactgcccttctcacgggctctatgcctgcactgggaaggaaacaaatgtgtataaactgctgtcaataaatgacacccagaccttccggctcaaaaaaaagacacccacgcccacacaggaccataccacacgccgctcacgacaggagctttcccgcgcccc

SEQ ID NO: 309511 - DNA, 705 bp, Homo sapiens
gcggggcagaggagctcatgcgcagtatgtgtggttggggaattcatgtggaggtcagagtggaagcaggtgtgagagggtccagcagaaggaaacatggctgccaaagtgtttgagtccattggcaagtttggcctggccttagctgttgcaggaggcgtggtgaactctgccttatataatgtggatgctgggcacagagctgtcatctttgaccgattccgtggagtgcaggacattgtggtaggggaagggactcattttctcatcccgtgggtacagaaaccaattatctttgactgccgttctcgaccacgtaatgtgccagtcatcactggtagcaaagatttacagaatgtcaacatcacactgcgcatcctcttccggcctgtcgccagccagcttcctcgcatcttcaccagcatcggagaggactatgatgagcgtgtgctgccgtccatcacaactgagatcctcaagtcagtggtggctcgctttgatgctggagaactaatcacccagagagagctggtctccaggcaggtgagcgacgaccttacagagcgagccgccacctttgggctcatcctggatgacgtgtccttgacacagccttccttctgctcccaccccagaaatcactgtgaaatttcatgattggcttaaagtgaaggaaataaaggtaaaatcacttcagatctctaa

SEQ ID NO: 309512 - DNA, 1056 bp, Homo sapiens
gtgacgatggtgatcgttgctgccgcggccgatatggaacccaagcagtggcgaagggaatcgcaaggctcttccctgaccattttctactgtccctgcgcgaggctgagttatgaacttcggtttggtttctttctgcaatccctgcagggccataaattcttggcccttaagactgggtggcccataacagactcagtgataccatcagtaaccacaattcacactggagtcaagttatctgattccccacacccagttggagaactggagattccttagaacttttaactgtcatgttttcaaagttgacatggaaaattttacatgaagcttaaaaatacaactaatctgtggtgatagagacgagaagagttaagctctaaaattagaagagcagttcgttttgaggcagcactgattgggagggagcatggagtatataattacacatttctatgtaatgtaaaaatgtatagatttaagatttatgcattttatgtaaattttactacaataaaacgaaaatgaaagaagacagatcatagtttaatcaaatattgtgtacaaagtaatttctgttaaacatttatatttttatgtgtatatgtatcttttacatgtatgtgttaaggatatgcattaaaatggtaataacttcctctgcctgttgggataatggagagttttgttactttttgtctttttttaaaacatgttcttcaataataatgtattgcttttgtaattatgaaaaacaaaagttattttgtaaatctttgttactgataagagatgggtattctgttaactactcaattctcatgtaggaaaacaaaatacataatgtctatttgataaatcgagaaacagaagcattacttagaaatctgagttacctctaaaataatgactggcatttgaagttgaggatgggtcttgagttcctgtgattttaagctcttggatatgagggttgggtgagttcctctttttctcttttaaaatatatgtatgtttaactttgctaaataaaatttaaaagatgcaatgtat

SEQ ID NO: 309513 - DNA, 861 bp, Homo sapiens
gtgacgatggtgatcgttgctgccgcggccgatatggaacccaagcagtggcgaagggaatcgcaaggctcttccctgaccattttctactgtccctgcgcgaggtgagggccccggctcggcctctgcaaaactttggggcgctggcgcggaggaggagacaggatttctcccgtgacttttgtaactgcgtcagggcaagatggcgctgggtctccttggggcgcggggggagaggcacgtccaccgccgcagcgcatgtgaccgggctgcattcctgtggggtttggctccgacccaggccggggcgggggaggggacagggcttgggcggaggagactgtggtgcggtcggcgttggcggcctgaagaggaagagatgactgttggaaagcgttcccctcccccatacggcagaacagctgcggctcccaggggaaagcccccgcaggacagtcctcgtggggtgtgacggctgttggtggagaaggtttggcgccctattttcttatctgcctttctccccgcaaagtatacttatgtaaggtggtagttccctgacgtgggactcggaatcaactaggagtccttgagggcctctgggaggcctagcgaggggtagaccagcttctgggggtacaacgtcaaggaggatcgattactttctgaggaaacagtttctcagattgaaatagaaaagtatttccaaagtttggaaacaaatttaaaggtgtaaataacacccaggaacactttaattgctttgaaaaggcataagcagccatctgaatttaagggcccttttcagactcttccttcctcctgtgatcctgttctttattcagtttctgtctgtcatcc

SEQ ID NO: 309514 - DNA, 4107 bp, Homo sapiens
gcagatttgtattttaacaagccttttaggaatgcagatattataggggataacatgaatggtggtaaagaggggggcatatttgagcaatgatttttcaagagctatgaatttacagtgcaatcctagcaggaaaagagagggagaaaagaacatctattttgagctgcagacataattgcatcacagctgagatttcatagtccccgtcctctctattcctgttgaattacatgattaaaggtaactatatatatatgaatatatgaagatgtttaattgttgcaggttggagaatttgggccagggagaattcacttggccaatgagttaaaaatgagaaaaggattagcagtcatcaaaatttctaagtagttaattatctgcatggtgggttcagtataaacaaacatggtactctcaaatgactgttgatgggctattaaattacattagtatcctgtgaaccctggtcatagctggaaaggagaatcttttgagaaatggaaaaaccaggttatttgtacataaggaatatgtcttttaaacacccccaaagtatagattaagacgtgattgatgaaaagtctccattttctaatgatggttttatgaaaccaaagtatttacaactaagaaccaaccatctgatcgccagtagagagtggaaaataggaaagggtaacgtctcagtatggtatctggagtagtctggctaggaccataaacttcattttgtttacaagttcccagaaaataagcctgaatgagcttagagcttaatacttccagtgatggttctctcttccctcaagtatacagattaactatttttgtgccgtgggcttttgacagcccccaaaagcccgtggatcccatctcagaatgttttacatgtgtattacataatgctcacacattctaaattttatctaccgactcctagttagaaatcccttgcaaggggtgttagggttctgagagaaggctggtaagtaatgaggcttttaacttatttcagtatcctgttcaggtcgggaatatgttgtgttctaattactctagtttccagctcaattggtgttggagaaactagcccacttataagtggctcaaatgaaaacccacggggaggcatttttctttaataagcaaccctaagccccctttgaagtcagtctgactaatcaaaagaaagaggttatatatcccagttttgaccttttgtgaaaatagcccttttactgtatgtgatatattattggcatctcattctgcacagtccaaatgatgtagacaaaatagtgattggtatataactatggacaccgaagatccactgcaaggcctgccgatcactttacacagaaggagcccctttcctgaggtccgcttgctcgctcggggtggggtggtactttgccctagtaaactaccaagcagtccgaacgttcgctcctctggaagaccgagttgtgggcggctgcgctgcgggggcaaactcgccgcatgcccgctggccagagcgagtcggggcctggcgttagggcaatccagactggccggcatggtacagggcgtatccctagccgccttctgtgtcatatggggcgccgccctccagcctaggagaggcggccgctaggaggggcagaagggccttgtctgccccggtctgaataccccaggcggggtcggaaagcgggtcacagaagagcccagtaaactgcaggggtgcagctcgtctccaggaaccggcaacccccagggccgcacaagccggtaacaacccataatccgatcctgtcttcgggatcagaagagaggacagctggcccgcgcgccagctcagttcctcctccgcattcttcaggaggagccccagaaacgcacttccgccgcgcgggcctgcctccacgcagggcgcgtcctaggccggttcatttccgcccagcgctttctgtggctaggggagtcaggggtttccttttcccttattcgggctcttatgttacccccgttttccgttgaacccttttctcccctcttgccctccaaaaaagcagtctgctgccgctcccgacttttctcgctgagacaccgtcagctcactccgagcccagcacagcggccatcttcggtaaattctggcagcagcccgcctgttcattgtcctgtgtgcccagaggaaagaactactcatttttcgtgatcaagctaggggaggcaggagcaataatggccctgctataggactggcttttatttgaattccaactcttctgccaccttaaccagctgtatccagattttaaaagttaatctatccgagcctcttattaaatattaggttgatgagatgatgcatgcaaagcgcttagaacagtactaggcataaagcgtccgacataaaggttaagtaaaagtaaggaaaagctatggggatgtattgagtatctctttgcccaatgacgtattagtcgtattaaatatggaaagtgcctttgattcgccgtgcccatgggagaaggcataggaatggccttttcccacctgtaatcagagagcaggtgtttcaagaacgcctcaatatgtttgcgatctctcacgcagcctttcaggctcctaattcctacgaagtttccgcttttattcaaattggctcactcctttttgcagggctttgtactgaatgagtattcttttaagggtggtggacaagcaaaggtttggtagcatcacatttttaatttcacagggaaaatgggtatgaaacatcttcccaagtacatcttagactgccagctgacagcaagccataatgctccccagctcttgggccctacaccccctctcccccatccccgctttagttctttgtcattgctcatggacagctggtttggggaccaggtgcagatgatgggaggtgtctgaaaaacagcaagtgagaaatgctagttttgttgttttaagttgcactgatgactccagtagttatctgtgctgcttgtgataatttataaggcaatgataacgaattaaacatacaaaagattattatcttccacaggaaaaaaaaactgcaaacttgtgacaccatttatgatccacttagtcttgagatactgagtaatagaactttctccttttaggctgagttatgaacttcggtttggtttctttctgcaatccctgcagggccataaattcttggcccttaagactgggtggcccataacagactcagtgataccatcagtaaccacaattcacactggagtcaagttatctgattccccacacccagttggagaactggagattccttagaacttttaactgtcatgttttcaaagttgacatggaaaattttacatgaagcttaaaaatacaactaatctgtggtgatagagacgagaagagttaagctctaaaattagaagagcagttcgttttgaggcagcactgattgggagggagcatggagtatataattacacatttctatgtaatgtaaaaatgtatagatttaagatttatgcattttatgtaaattttactacaataaaacgaaaatgaaagaagacagatcatagtttaatcaaatattgtgtacaaagtaatttctgttaaacatttatatttttatgtgtatatgtatcttttacatgtatgtgttaaggatatgcattaaaatggtaataacttcctctgcctgttgggataatggagagttttgttactttttgtctttttttaaaacatgttcttcaataataatgtattgcttttgtaattatgaaaaacaaaagttattttgtaaatctttgttactgataagagatgggtattctgttaactactcaattctcatgtaggaaaacaaaatacataatgtctatttgataaatcgagaaacagaagcattacttagaaatctgagttacctctaaaataatgactggcatttgaagttgaggatgggtcttgagttcctgtgattttaagctcttggatatgagggttgggtgagttcctctttttctcttttaaaatatatgtatgtttaactttgctaaataaaatttaaaagatgcaatgtat

SEQ ID NO: 309515 - DNA, 875 bp, Homo sapiens
agtttgaagaaggctcttacagcatggccgccggtactgcagctgccttagcgtttttgagtcaggagagccgaacgcgggccgggggtgtcgggggcctacgggtcccggccccggtcactatggacagttttttcttcggctgtgagctctccggccacacccgctccttcacctttaaggtagaggaagaggatgatgcggagcacgtgctggcactaaccatgctctgcctcaccgagggagccaaagacgagtgtaatgtggtagaagttgtggcccggaaccatgaccatcaggagatcgcagtccctgtggccaacctcaagctgtcctgccaacccatgctcagtctggatgacttccagctccaaccacctgtaaccttccgcctgaagtcgggctctggccctgtgcggatcactgggcggcaccagattgttacgatgagcaatgatgtttctgaggaggagagcgaggaagaggaagaggacagtgatgaggaagaagttgagctgtgccccatccttcctgccaaaaagcaggggggcaggccctagccctcctaggtcagctccatgtgccatgcaccgccatgcaccctgttccctgacaagtttcaacaattgtaaatatttcttccttgaagaggagagcttgggtgggggttgggtgggagggacttgggtctttggtgctaggagagggcctgtgctccacacagccgtggttttctgattttcaccatgcccggggcctcccttcccacctgcctgtgagaattggaggttagtgcctgaagctcagagctacacatttttaatagtttttacatttttggataaaggttgaaataaagtggtgtggagtttttg

SEQ ID NO: 309516 - DNA, 1339 bp, Homo sapiens
agtttgaagaaggctcttacagcatggccgccggtactgcagctgccttagcgtttttgagtcaggagagccgaacgcgggccgggggtgtcgggggcctacgggtcccggccccggtcactatggacagttttttcttcggctgtgagctctccggccacacccgctccttcacctttaaggtagaggaagaggatgatgcggagcacgtgctggcactaaccatgctctgcctcaccgagggagccaaagacgagtgtaatgtggtagaagttgtggcccggaaccatgaccatcaggagatcgcagtccctgtggccaacctcaagctgtcctgccaacccatgctcagtctggatgacttccagctccaaccacctgtaaccttccgcctgaagtcgggctctggccctgtgcggatcactgggcggcaccagattgttacgatgagcaatgatgtttctgaggaggagagcgaggaagaggaagaggacagtgatgaggaagaagttgagctgtgccccatccttcctgccaaaaagcaggggggcaggccctagccctcctaggtcagctccatgtgccatgcaccgccatgcaccctgttccctgacaagtttcaacaattgtaaatatttcttccttgaagaggagagcttgggtgggggttgggtgggagggacttgggtctttggtgctaggagagggcctgtgctccacacagccgtggttttctgattttcaccatgcccggggcctcccttcccacctgcctgtgagaattggaggttagtgcctgaagctcagagctacacatttttaatagtttttacatttttggataaaggttgaaataaagtggtgtggagtttttgcagctcttgtgtggcttcttcctgtgctgggtgatgtttccctagggaccgccaggtggcactgtggaagcccccagcgtggccctgggcctgggggagggtggagaactgtgggatcctctaccctcatggccctgggctaggacctggggcctgggcgccagttgccttgctggaaggggacctcccaacactcagcccattcccagtctctgcaggtgggagagggtcatcgcaggaggttatcagcatccaaacaaggggtctgggcctctgtcagcactcggctgatgggcaggggggcagataagcgagcttaggcagcctgaggaatgcgcgtccctagccccacgagggtctctggcccagagagggcctgtgagggcagggcgggaccaggcttcgctcctcctttgagccttgcaggctgtctctgagcagggctgggcccttagagaaacctg

SEQ ID NO: 309517 - DNA, 931 bp, Homo sapiens
agtttgaagaaggctcttacagcatggccgccggtactgcagctgccttagcgtttttgagtcaggagagccgaacgcgggccgggggtgtcgggggcctacgggtcccggccccggtcactatggacagttttttcttcggctgtgagctctccggccacacccgctccttcacctttaaggtagaggaagaggatgatgcggagcacgtgctggcactaaccatgctctgcctcaccgagggagccaaagacgagtgtaatgtggtagaagttgtggcccggaaccatgaccatcaggagatcgcagtccctgtggccaacctcaagctgtcctgccaacccatgctcagtctggatgacttccagctccaaccacctgtaaccttccgcctgaagtcgggctctggccctgtgcggatcactgggcggcaccagattgttacgatgagcaatgatgtttctgaggaggagagcgaggaagaggaagaggacagtgatgaggaagaagttgagctgtgccccatccttcctgccaaaaagcaggggggcaggccctagccctcctaggtcagctccatgtgccatgcaccgccatgcaccctgttccctgacaagtttcaacaattgtaaatatttcttccttgaagaggagagcttgggtgggggttgggtgggagggacttgggtctttggtgctaggagagggcctgtgctccacacagccgtggttttctgattttcaccatgcccggggcctcccttcccacctgcctgtgagaattggaggttagtgcctgaagctcagagctacacatttttaatagtttttacatttttggataaaggttgaaataaagtggtgtggagtttttgttttttttttttttttttttttttttttgggaaaaatttttttttttaaaaaaaaa

SEQ ID NO: 309518 - DNA, 789 bp, Homo sapiens
agtttgaagaaggctcttacagcatggccgccggtactgcagctgccttagcgtttttgagtcaggagagccgaacgcgggccgggggtgtcgggggcctacgggtcccggccccggtcactatggacagttttttcttcgctctgcctcaccgagggagccaaagacgagtgtaatgtggtagaagttgtggcccggaaccatgaccatcaggagatcgcagtccctgtggccaacctcaagctgtcctgccaacccatgctcagtctggatgacttccagctccaaccacctgtaaccttccgcctgaagtcgggctctggccctgtgcggatcactgggcggcaccagattgttacgatgagcaatgatgtttctgaggaggagagcgaggaagaggaagaggacagtgatgaggaagaagttgagctgtgccccatccttcctgccaaaaagcaggggggcaggccctagccctcctaggtcagctccatgtgccatgcaccgccatgcaccctgttccctgacaagtttcaacaattgtaaatatttcttccttgaagaggagagcttgggtgggggttgggtgggagggacttgggtctttggtgctaggagagggcctgtgctccacacagccgtggttttctgattttcaccatgcccggggcctcccttcccacctgcctgtgagaattggaggttagtgcctgaagctcagagctacacatttttaatagtttttacatttttggataaaggttgaaataaagtggtgtggagtttttg

SEQ ID NO: 309519 - DNA, 4875 bp, Homo sapiens
ggaattccgggaggagcggacgtcggcttctccccgcgggagcccccagcatggttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagaagaccaagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggatttggagacatttttaaagaaggctctgtgaaacttcggacaagaacatccagtagtgaaacagaagagaaaaaaccagaaaagcccttaatcctacagtcactgggacccaaaactcagagtgtggagataacaaaaacagataccgaaggtaaaattaaagctaaagaatattgtagaacattatttgcctatgaaggtactaatgaagatgaacttacttttaaagagggggagataatccatttgataagtaaggagactggagaagctggctggtggaggggcgaacttaatggtaaagaaggagtatttccagacaattttgctgtccagataaatgaacttgataaagactttccaaaaccaaagaaaccaccacctcctgctaaggctccagctccaaagcctgaactgatagctgcagagaagaaatatttttctttaaagcctgaagaaaaggatgaaaaatcaacactggaacagaaaccttctaaaccagcagctccacaagtcccacccaagaaacctactccacctaccaaagccagtaatttattgagatcttctggaacagtgtacccaaagcgacctgaaaaaccagttcctccaccacctcctatagccaagattaatggggaagtttctagcatttcatcaaaatttgaaactgagccagtatcaaaactaaagctagattctgaacagctgccccttagaccaaaatcagtagactttgattcacttacagtaaggacctccaaagaaacagatgttgtaaattttgatgacatagcttcctcagaaaacttgcttcatctcactgcaaatagaccaaagatgcctggaagaaggttgccgggccgtttcaatggtggacattctccaactcacagccccgaaaaaatcttgaagttaccaaaagaagaagacagtgccaacctgaagccatctgaattaaaaaaagatacatgctactctccaaagccatctgtgtacctttcaacaccttccagtgcttctaaagcaaatacaactgctttcctgactccattagaaatcaaagctaaagtggaaacagatgatgtgaaaaaaaattccctggatgaacttagagcccagattattgaattgttgtgcattgtagaagcactgaaaaaggatcacgggaaagaactggaaaaactgcgaaaagatttggaagaagagaagacaatgagaagtaatctagagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgtaagatatactatttgagagggacagattagccttttagtaactatagtcactactttttccataatgcataagggatataaactctgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcagaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatagttgaacatatttaaaatacattttcacagaatggatgaattagttgtttcttcagagttacttatgaacagttgaatgctttaaaatgttctgtctgtaggtaacatctaaaacacaagtgggtttatttaaatttttaaaatttgaaattttttatttgcaaaaaattgttttatgctttattatatcgcaaatgagtgtcagatttttgagtaccaatgatcatgcttccattttttttagttttaaaccaccaaaccaatatttttcctttaaattttaatcttataatatagaaatcttatgtaaatgaaattttgtcatgtttcaaataaagagaactgaagtagaaaatagaaatgccagtaaacaacataatgtttaatttacaacttacattaggggtttgggggaatgctaattatatattgagaatatacattagaactcttcaaaatgggctcttctaatgaggtcactactgaacaaaattgttccctcttctgttaaatagaataggtttaaatgactagtcaaatgaattattttcttcttgttaaataaattaaatcttactttcttttaatgaccaaccttaggtaaaacaaaaatattgtaatcctagaaattatcctccagctttctcacctgaaaatctattgaagtgatccctggtcatcctaataatgggatgagggaagtttccagcagatttcaggctgttcttaaagtttttgttggtcattttctcaatagtacatgaaatcaagatgcttatgagcatggaaatgtatttaaagtttttgcttgtgtcctcctcagtcagaatagaaaagtaactgaaatactcttacctttctgtccttgataaaatagtaaagaaaaccaaacaaacccaggcctgatgggaaaaatgattcctttattctagcaacttactttctgttggtatgggaaatgttattaatttctattactaaagttcatatcacaaaatgatatttaataataaccttggggtaaatcatgaatttttttttctacgtgtgagtataaaagacaaaagttgaacagcatggaatctcattgccaaattattagtgaatgtatagttcaggtattctttgagacacacagtatcattaatttccgaattgtatttcagtgttattttttgtttgtgaccactaagcttctgtcttaatacaaagctgttaccttctacagaatttaagtctgaagatgtaaagagagaacaggccttgtgtaacagaagatactcttttttatgctccttactgtgatcacagaaaaattaaaaatccaagtgctctctagatttgttgataaacattttatgcttgcatttaaacttgaaatgtatgagcagaatgagacaatcagttaaatcagaaatgagaagtattataatgtaaaggccttgttttgctgtagcaataaaatgaccaagtgcaatgacttgatttaataaaatcatattttaaaagttgctgctatgaatatttttggctataaaattttaccctgacttgctttcaataactgttacgtaatgcagttgatgttgtaacctaacattccaaaaaaaaaattgagagggggaatctcaaaatagtatatacttcactaacttgtttacaggtgctgtatttaaaagcatgcttctctctcaaaaagaaaaattaaaggattttattgcc

SEQ ID NO: 309520 - DNA, 3853 bp, Homo sapiens
  misc_feature (28)..(28): n is a, c, g, or t
ttcgagcgcggtaccccctttggggtcnttgctccaaaaccaaagaaaccaccacctcctgctaaggctccagctccaaagcctgaactgatagctgcagagaagaaatatttttctttaaagcctgaagaaaaggatgaaaaatcaacactggaacagaaaccttctaaaccagcagctccacaagtcccacccaagaaacctactccacctaccaaagccagtaatttattgagatcttctggaacagtgtacccaaagcgacctgaaaaaccagttcctccaccacctcctatagccaagattaatggggaagtttctagcatttcatcaaaatttgaaactgagccagtatcaaaactaaagctagattctgaacagctgccccttagaccaaaatcagtagactttgattcacttacagtaaggacctccaaagaaacagatgttgtaaattttgatgacatagcttcctcagaaaacttgcttcatctcactgcaaatagaccaaagatgcctggaagaaggttgccgggccgtttcaatggtggacattctccaactcacagccccgaaaaaatcttgaagttaccaaaagaagaagacagtgccaacctgaagccatctgaattaaaaaaagatacatgctactctccaaagccatctgtgtacctttcaacaccttccagtgcttctaaagcaaatacaactgctttcctgactccattagaaatcaaagctaaagtggaaacagatgatgtgaaaaaaaattccctggatgaacttagagcccagattattgaattgttgtgcattgtagaagcactgaaaaaggatcacgggaaagaactggaaaaactgcgaaaagatttggaagaagagaagacaatgagaagtaatctagagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgtaagatatactatttgagagggacagattagccttttagtaactatagtcactactttttccataatgcataagggatataaactctgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcagaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatagttgaacatatttaaaatacattttcacagaatggatgaattagttgtttcttcagagttacttatgaacagttgaatgctttaaaatgttctgtctgtaggtaacatctaaaacacaagtgggtttatttaaatttttaaaatttgaaattttttatttgcaaaaaattgttttatgctttattatatcgcaaatgagtgtcagatttttgagtaccaatgatcatgcttccattttttttagttttaaaccaccaaaccaatatttttcctttaaattttaatcttataatatagaaatcttatgtaaatgaaattttgtcatgtttcaaataaagagaactgaagtagaaaatagaaatgccagtaaacaacataatgtttaatttacaacttacattaggggtttgggggaatgctaattatatattgagaatatacattagaactcttcaaaatgggctcttctaatgaggtcactactgaacaaaattgttccctcttctgttaaatagaataggtttaaatgactagtcaaatgaattattttcttcttgttaaataaattaaatcttactttcttttaatgaccaaccttaggtaaaacaaaaatattgtaatcctagaaattatcctccagctttctcacctgaaaatctattgaagtgatccctggtcatcctaataatgggatgagggaagtttccagcagatttcaggctgttcttaaagtttttgttggtcattttctcaatagtacatgaaatcaagatgcttatgagcatggaaatgtatttaaagtttttgcttgtgtcctcctcagtcagaatagaaaagtaactgaaatactcttacctttctgtccttgataaaatagtaaagaaaaccaaacaaacccaggcctgatgggaaaaatgattcctttattctagcaacttactttctgttggtatgggaaatgttattaatttctattactaaagttcatatcacaaaatgatatttaataataaccttggggtaaatcatgaatttttttttctacgtgtgagtataaaagacaaaagttgaacagcatggaatctcattgccaaattattagtgaatgtatagttcaggtattctttgagacacacagtatcattaatttccgaattgtatttcagtgttattttttgtttgtgaccactaagcttctgtcttaatacaaagctgttaccttctacagaatttaagtctgaagatgtaaagagagaacaggccttgtgtaacagaagatactcttttttatgctccttactgtgatcacagaaaaattaaaaatccaagtgctctctagatttgttgataaacattttatgcttgcatttaaacttgaaatgtatgagcagaatgagacaatcagttaaatcagaaatgagaagtattataatgtaaaggccttgttttgctgtagcaataaaatgaccaagtgcaatgacttgatttaataaaatcatattttaaaagttgctgctatgaatatttttggctataaaattttaccctgacttgctttcaataactgttacgtaatgcagttgatgttgtaacctaacattccaaaaaaaaaattgagagggggaatctcaaaatagtatatacttcactaacttgtttacaggtgctgtatttaaaagcatgcttctctctcaaaaagaaaaattaaaggattttattgcc

SEQ ID NO: 309521 - DNA, 3003 bp, Homo sapiens
  misc_feature (1)..(1): n is a, c, g, or t
  misc_feature (6)..(6): n is a, c, g, or t
ntcggnagaatgcaatctgcgaagtatggaagaggaaaaatgagagtaatctagagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgtaagatatactatttgagagggacagattagccttttagtaactatagtcactactttttccataatgcataagggatataaactctgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcagaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatagttgaacatatttaaaatacattttcacagaatggatgaattagttgtttcttcagagttacttatgaacagttgaatgctttaaaatgttctgtctgtaggtaacatctaaaacacaagtgggtttatttaaatttttaaaatttgaaattttttatttgcaaaaaattgttttatgctttattatatcgcaaatgagtgtcagatttttgagtaccaatgatcatgcttccattttttttagttttaaaccaccaaaccaatatttttcctttaaattttaatcttataatatagaaatcttatgtaaatgaaattttgtcatgtttcaaataaagagaactgaagtagaaaatagaaatgccagtaaacaacataatgtttaatttacaacttacattaggggtttgggggaatgctaattatatattgagaatatacattagaactcttcaaaatgggctcttctaatgaggtcactactgaacaaaattgttccctcttctgttaaatagaataggtttaaatgactagtcaaatgaattattttcttcttgttaaataaattaaatcttactttcttttaatgaccaaccttaggtaaaacaaaaatattgtaatcctagaaattatcctccagctttctcacctgaaaatctattgaagtgatccctggtcatcctaataatgggatgagggaagtttccagcagatttcaggctgttcttaaagtttttgttggtcattttctcaatagtacatgaaatcaagatgcttatgagcatggaaatgtatttaaagtttttgcttgtgtcctcctcagtcagaatagaaaagtaactgaaatactcttacctttctgtccttgataaaatagtaaagaaaaccaaacaaacccaggcctgatgggaaaaatgattcctttattctagcaacttactttctgttggtatgggaaatgttattaatttctattactaaagttcatatcacaaaatgatatttaataataaccttggggtaaatcatgaatttttttttctacgtgtgagtataaaagacaaaagttgaacagcatggaatctcattgccaaattattagtgaatgtatagttcaggtattctttgagacacacagtatcattaatttccgaattgtatttcagtgttattttttgtttgtgaccactaagcttctgtcttaatacaaagctgttaccttctacagaatttaagtctgaagatgtaaagagagaacaggccttgtgtaacagaagatactcttttttatgctccttactgtgatcacagaaaaattaaaaatccaagtgctctctagatttgttgataaacattttatgcttgcatttaaacttgaaatgtatgagcagaatgagacaatcagttaaatcagaaatgagaagtattataatgtaaaggccttgttttgctgtagcaataaaatgaccaagtgcaatgacttgatttaataaaatcatattttaaaagttgctgctatgaatatttttggctataaaattttaccctgacttgctttcaataactgttacgtaatgcagttgatgttgtaacctaacattccaaaaaaaaaattgagagggggaatctcaaaatagtatatacttcactaacttgtttacaggtgctgtatttaaaagcatgcttctctctcaaaaagaaaaattaaaggattttattgcc

SEQ ID NO: 309522 - DNA, 4418 bp, Homo sapiens
ggaattccgggaggagcggacgtcggcttctccccgcgggagcccccagcatggttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagaagaccaagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggatttggagacatttttaaagaaggctctgtgaaacttcggacaagaacatccagtagtgaaacagaagagaaaaaaccagaaaagcccttaatcctacagtcactgggacccaaaactcagagtgtggagataacaaaaacagataccgaaggtaaaattaaagctaaagaatattgtagaacattatttgcctatgaaggtactaatgaagatgaacttacttttaaagagggggagataatccatttgataagtaaggagactggagaagctggctggtggaggggcgaacttaatggtaaagaaggagtatttccagacaattttgctgtccagataaatgaacttgataaagactttccaaaaccaaagaaaccaccacctcctgctaaggctccagctccaaagcctgaactgatagctgcagagaagaaatatttttctttaaagcctgaagaaaaggatgaaaaatcaacactggaacagaaaccttctaaaccagcagctccacaagtcccacccaagaaacctactccacctaccaaagccagtaatttattgagatcttctggaacagtgtacccaaagcgacctgaaaaaccagttcctccaccacctcctatagccaagattaatggggaagtttctagcatttcatcaaaatttgaaactgagccagtatcaaaactaaagctagattctgaacagctgccccttagaccaaaatcagtagactttgattcacttacagtaaggacctccaaagaaacagatgttgtaaattttgatgacatagcttcctcagaaaacttgcttcatctcactgcaaatagaccaaagatgcctggaagaaggttgccgggccgtttcaatggtggacattctccaactcacagccccgaaaaaatcttgaagttaccaaaagaagaagacagtgccaacctgaagccatctgaattaaaaaaagatacatgctactctccaaagccatctgtgtacctttcaacaccttccagtgcttctaaagcaaatacaactgctttcctgactccattagaaatcaaagctaaagtggaaacagatgatgtgaaaaaaaattccctggatgaacttagagcccagattattgaattgttgtgcattgtagaagcactgaaaaaggatcacgggaaagaactggaaaaactgcgaaaagatttggaagaagagaagacaatgagaagtaatctagagatggaaatagagaagctgaaaaaagctgtcctgtcttcttgagtggtgtggacctggtgttcataatgttccagggattcagaagcaacgctatgaacttcagctgacttgttacttaaaaattgtgaattctgttgttgtgataaatatgagcaaatgaagtgtaatatctatagaaaagtagagtgagggtgaatttatatatatattttgttttgccaatatgaagaaaaagaggccttatttcttaactgtgctgggattgcaaacactttttaaaaaattgtttgcttgaaaatactactgaatataaataagaatgtgcacagtagtttttttattgaaacttgtattatttttaaagagatctatactataaatatggtgatatatttacaagtaatctgtaagatatactatttgagagggacagattagccttttagtaactatagtcactactttttccataatgcataagggatataaactctgtgtgtgtgtgtgtgtgtgtgtgtgtgtgtgtgtgtgtatatatatatatatatttttacttttatcctcttaccgaaggttacactgttgtgcctgtttgtctgcaatgctgtttatattttgggtgatgaaataggagtttcctagctatataaaccagattactcacccatgcatatagtaagaactaatgaataatcaaaataatttcatcaacttttagaatattttatgttgcttgcactataggagtcataaaaggaacttagttaaaatatgttggattgttaaacatttggggaaatatgaactgtattttaaatttgttaggtctgaagaatctaaaactgttaatttaacccttaacttgtgcctagaaactacagcacatataaaatatgtaaacaccagcctgttgctgtacttttctgcttattttacagcctcaaatatttctcattatcttgtcacttagttcttcatgtttctccttctgacttttaataatggtaataggaaaacaaaacccaaagcttttcagaacttcagtgtgaggtttcctattttgacaagttaacttgtaaatactcaggttttacgatgtataatttacctaatagaccaaactaactcatggagatattttgaactattatttaggtacaaactttataaagaatgttagtatgtcataaaatataacattacagcttatttaaaaccaaatatagttgaacatatttaaaatacattttcacagaatggatgaattagttgtttcttcagagttacttatgaacagttgaatgctttaaaatgttctgtctgtaggtaacatctaaaacacaagtgggtttatttaaatttttaaaatttgaaattttttatttgcaaaaaattgttttatgctttattatatcgcaaatgagtgtcagatttttgagtaccaatgatcatgcttccattttttttagttttaaaccaccaaaccaatatttttcctttaaattttaatcttataatatagaaatcttatgtaaatgaaattttgtcatgtttcaaataaagagaactgaagtagaaaatagaaatgccagtaaacaacataatgtttaatttacaacttacattaggggtttgggggaatgctaattatatattgagaatatacattagaactcttcaaaatgggctcttctaatgaggtcactactgaacaaaattgttccctcttctgttaaatagaataggtttaaatgactagtcaaatgaattattttcttcttgttaaataaattaaatcttactttcttttaatgaccaaccttaggtaaaacaaaaatattgtaatcctagaaattatcctccagctttctcacctgaaaatctattgaagtgatccctggtcatcctaataatgggatgagggaagtttccagcagatttcaggctgttcttaaagtttttgttggtcattttctcaatagtacatgaaatcaagatgcttatgagcatggaaatgtatttaaagtttttgcttgtgtcctcctcagtcagaatagaaaagtaactgaaatactcttacctttctgtccttgataaaatagtaaagaaaaccaaacaaacccaggcctgatgggaaaaatgattcctttattctagcaacttactttctgttggtatgggaaatgttattaatttctattactaaagttcatatcacaaaatgatatttaataataaccttggggtaaatcatgaatttttttttctacgtgtgagtataaaagacaaaagttgaacagcatggaatctcattgccaaattattagtgaatgtatagttcaggtattctttgagacacacagtaaataatggctgaccagcatgagggcagtactgtcagaaatttctttgagctgtgagatggatttatttttaaatgctactttgtaaaggtgacctttaaaaaataaaaggaaaataaagaatgtt

SEQ ID NO: 309523 - DNA, 1856 bp, Homo sapiens
ggaattccgggaggagcggacgtcggcttctccccgcgggagcccccagcatggttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagaagaccaagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggatttggagacatttttaaagaaggctctgtgaaacttcggacaagaacatccagtagtgaaacagaagagaaaaaaccagaaaagcccttaatcctacagtcactgggacccaaaactcagagtgtggagataacaaaaacagataccgaaggtaaaattaaagctaaagaatattgtagaacattatttgcctatgaaggtactaatgaagatgaacttacttttaaagagggggagataatccatttgataagtaaggagactggagaagctggctggtggaggggcgaacttaatggtaaagaaggagtatttccagacaattttgctgtccagataaatgaacttgataaagactttccaaaaccaaagaaaccaccacctcctgctaaggctccagctccaaagcctgaactgatagctgcagagaagaaatatttttctttaaagcctgaagaaaagggtgaggctaattttcaactttcaaaaaagcaattatttcttttattgtcattttaaagagaattatttctccacactgagtcatttacactgatttttaacaggtattcagtatgtatttaacaatgcttggagttttctgggagggagtagttcatttctcaaacagataacaatttacattcattaaaaaattaaactattcagtaggatgttgtctttattcagttatttcacagactgtataagaaaactaagcattaaataactatgcttttattatttttatagtgtttcagtttttaaaaaattccttagaatgttgaagacccagttcctacttaagcatgaaaataattaattacatattatttaatctcactgcatgtgtttgtcataatgtaaacctggaaagttattccagggtaccacatgtattttgctaaaaaccttattggtttgttgtgaatttggagaaaataagtccttctcattgcacataaagatttgcaatgattgtcactagtagattagtttatatacatcaagaaacttgaatactattttagaatgctttttgtttcttcctccagtgttgtagtctaatccatccttgtttcttgcctaaagtattgtatcctcttacttgatttctctcactttagctccttttctggctcatacttcatgttgttgcca

SEQ ID NO: 309524 - DNA, 1738 bp, Homo sapiens
ggaattccgggaggagcggacgtcggcttctccccgcgggagcccccagcatggttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagaagaccaagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggatttggagacatttttaaagaaggctctgtgaaacttcggacaagaacatccagtagtgaaacagaagagaaaaaaccagaaaagcccttaatcctacagtcactgggacccaaaactcagagtgtggagataacaaaaacagataccgaaggtaaaattaaagctaaagaatattgtagaacattatttgcctatgaaggtactaatgaagatgaacttacttttaaagagggggagataatccatttgataagtaaggagactggagaagctggctggtggaggggcgaacttaatggtaaagaaggagtatttccagacaattttgctgtccagataaatgaacttgataaagactttccaaaaccaaagaaaccaccacctcctgctaaggctccagctccaaagcctgaactgatagctgcagagaagaaatatttttctttaaagcctgaagaaaaggatgaaaaatcaacactggaacagaaaccttctaaaccagcagctccacaagtcccacccaagaaacctactccacctaccaaagccagtaatttattgagatcttctggaacagtgtacccaaagcgacctgaaaaaccagttcctccaccacctcctatagccaagattaatggggaagtttctagcatttcatcaaaatttgaaactgagccagtatcaaaactaaagctagattctgaacagctgccccttagaccaaaatcagtagactttgattcacttacagtaaggacctccaaagaaacagatgttgtaaattttgatgacatagcttcctcagaaaacttgcttcatctcactgcaaatagaccaaagatgcctggaagaaggttgccgggccgtttcaatggtggacattctccaactcacagccccgaaaaaatcttgaagttaccaaaagaagaagacagtgcctctgcctcgagggccgcgctgaagagactggtagagcgccgcgggcggatggaggcgactcttcgccccgcctgagctcaggaggggctagcgcggagcgcggg

SEQ ID NO: 309525 - DNA, 1497 bp, Homo sapiens
ggaattccgggaggagcggacgtcggcttctccccgcgggagcccccagcatggttgactatattgtggagtatgactatgatgctgtacatgatgatgaattaactattcgagttggagaaatcatcaggaatgtgaaaaagctacaggaggaagggtggctggaaggagaactaaatgggagaagaggaatgttccctgacaatttcgttaaggaaattaaaagagagacggaattcaaggatgacagtttgcccatcaaacgggaaaggcatgggaatgtagcaagtcttgtacaacgaataagcacctatggacttccagctggaggaattcagccacatccacaaaccaaaaacattaagaagaagaccaagaagcgtcagtgtaaagttctttttgagtacattccacaaaatgaggatgaactggagctgaaagtgggagatattattgatattaatgaagaggtagaagaaggctggtggagtggaaccctgaataacaagttgggactgtttccctcaaattttgtgaaagaattagaggtaacagatgatggtgaaactcatgaagcccaggacgattcagaaactgttttggctgggcctacttcacctataccttctctgggaaatgtgagtgaaactgcatctggatcagttacacagccaaagaaaattcgaggaattggatttggagacatttttaaagaaggctctgtgaaacttcggacaagaacatccagtagtgaaacagaagagaaaaaaccagaaaagcccttaatcctacagtcactgggacccaaaactcagagtgtggagataacaaaaacagataccgaaggtaaaattaaagctaaagaatattgtagaacattatttgcctatgaaggtactaatgaagatgaacttacttttaaagagggggagataatccatttgataagtaaggagactggagaagctggctggtggaggggcgaacttaatggtaaagaaggagtatttccagacaattttgctgtccagataaatgaacttgataaagactttccaaaaccaaagaaaccaccacctcctgctaaggctccagctccaaagcctgaactgatagctgcagagaagaaatatttttctttaaagcctgaagaaaaggatgaaaaatcaacactggaacagaaaccttctaaaccagcagctccacaagtcccacccaagaaacctactccacctaccaaagccagtaatttattgagatcttctggaacagtgtacccaaagcgacctgaaaaaccagttcctccaccacctcctatagccaagattaatggggaagtttctagcatttcatcaaaatttgaaactgagccagtatcaaaactaaagctagattctgaacagctgccccttagaccaaaatcagtagactttgattcacttacagtaaggacctccaaagaaacaggtaagtcagcatggacagcggtggtgcatt

SEQ ID NO: 309526 - DNA, 4047 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309527 - DNA, 3900 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309528 - DNA, 3878 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309529 - DNA, 3740 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309530 - DNA, 1247 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccggtgaggccccagtgggtggagggaa

SEQ ID NO: 309531 - DNA, 1269 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagagccgagggtgtggagtatgccggggctgtcagacccaagaggattgtggccattgccccatctgccttcgccctccccgccctggtctcaggcgccagtggaaatgtgtccagcgacgttgcctacggtgatgaactactcccttcctgccttcagtaacaacattacaggaagagaggagagaaaggtaggagttaaagatccagtcatttgtttccatctaaagtgccctataagccgggcatcgtggcgcaagcctgtagtcccagctactcgggaggctggggcaggagaatcacttgagcccaggagttggaggccgcagtgagctgtgatcatgccactgcattccagcctgggcgacagagtgagacccagactcagctgaaaaataataatattattaaaagaatttaaaataaagtgttccatagatgtg

SEQ ID NO: 309532 - DNA, 1075 bp, Homo sapiens
gtaaattgcgtccttaagagggcatacacattagttgtacttattatatgtcagtttgacgtaggtactgatttgttgcatgtgctcacaagtgttctatgctcacccccactttagaatgggagtatcacagtgtcattcttaattggcttttaggtattaccaccttgctcttgactggaaatgcaactgtggttaccacctgtgctgcaggtccgtcctggttccctgatttgtgtttcctgttctgcctggatcctgattctcagaaaccagttactggacttctgatccacatcctgaccctggtccactgtgaccctcagactcttaattatgctccaccaggtcgtgccactgccccactagtccatttgatctgcccccatcctaggatatcctgagtctaagccctggtttctgccaatggcaaataggaagattttattaacaggttttaaaaaattattattattactggttatttggtttgacaaggcacttaggctccctgagctttgccttagctggaaaataaggatagtattacttgctattctatcaaccctgtaagatatttgcggccacgcgcggtagcgcaccctgtaattccaacactttgggaggccggcgggaggggcagtggggaggatcgcttgaacccaggagcaggagttccagcctgagcaacatagcgggaccccctgtctcttcaaaatttgtttttaaattagcagggcgtggtggcgcaggctctgtagtcccagatactctggaggctgaggcccaggaggacgaggctgcagggagccatgatcacgccacggcactccaccctgggcgacagagcgagaccttgtctcagaaaaaatctgtgaggttaaaaggctgtgtgtgtgaaaatatcttggaaattgtaaagaactacacaaatataaggttttcctgtgattattaccgtcatcaagattaacctacagatagtgcaaaatttaagcttcccaaaaaatgttcgctaacctttttcatacttttagaccattacaagatataaatagcaaagtcaactggaatt

SEQ ID NO: 309533 - DNA, 560 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagaggtactgggtgggtagtgggcagagtcaggagtggggtagagcctgattctggtaaaatcaaatggtgtggttaaatttatggatgaagtttaaattatgcacatacagttaatccttattagcggattttatgtttg

SEQ ID NO: 309534 - DNA, 5697 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309535 - DNA, 5528 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309536 - DNA, 5390 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309537 - DNA, 5693 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgcggcggttttccgcctgggtggcacccgcttccgggataccgccgtctggttgcccgggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309538 - DNA, 5803 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaagggtgagttgggcaagtggaaagagcccaaggctcacctcggcccctggcccccatgggcttggccccatgcttcatgcctctgctcccacctgccccccgccaacagagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309539 - DNA, 5559 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309540 - DNA, 3768 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309541 - DNA, 5603 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggcaccttgctcaccgcctgcgtcgccgtcatcagagatgtcagcgacgcactcccctggctgtggctcccccaactggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctaaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309542 - DNA, 5656 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309543 - DNA, 4600 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattaca

SEQ ID NO: 309544 - DNA, 4660 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcaga

SEQ ID NO: 309545 - DNA, 3975 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309546 - DNA, 4488 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaagcctcgtgtaggcactgtactttactaggatacgg

SEQ ID NO: 309547 - DNA, 3741 bp, Homo sapiens
aagatataaaaaaagataaaggataattaaggggaagtggatggaggacacagaatagtaggaaatggttttgtaatgctccattgcgcacatagcaaacctcattcaacatacagacctgctcccttttccctaggtccaaagaccttaaaaaacctggagctagaaagcagtagactggaggcttctacagactgtaggattcaaggtgatatttgcagactggctttatgagagacaacactgatctactaggggctggaccctagattggttgccagggcttgtgtgtgaatcaaccctaggaggaaaaacctactaccaaaccagaagagcaggcctaagagtactttgagcttctagaagaagtaagcgggaaaggaagagaaagagtagaaagttggtgcatcttctcctccccaagagcctgagtataagaagttggattttaagggtgggggagctgggttggagaaaggtaatataattaaagccaccacaaaacaacctaaacaagccatgttcatgagtaattgtaagtggcttctggatgagacctggcagtgtctctacatacttcctcagggagatagcaattgaaaatgtaattgaataaataaggaaaggaactgctatttggtgtgttcctctgtggacccagtttatttaatccttaaaataatatttttgggaagacattgattttgtccatttatgtggatgggaaaactgagactcattaatttgtccaatgtcgaacagctggtgttagtagagcctagactcaaacccagcttttaaagcccttgttctttactccactaaactgtaacctgtaatcctgtatgcactaacaggagttttcggtgaccttgaaaacacagattactataattactataataaatcccttacattcctgtctctagcatggtttagggagtgccaaggctcaatgtagatggggtcaccttgtcagagcatctgttcatacagaaactgggtttcctgcagaccccaggtgctgcataggattcctcaaaccctacaggatatatctccccactggctgctgtccattttgcttgttaccctgactccccctcttcagccagagcagtctttgtaactaaagctgccagcctggctcatctttcctgacaacgtgcatctcctgccctgtgatcacctttgtgcttggctcctgccctcagcctgaatgtgttctaggaggctgaattcctgcttcgagtcctgcccaagagccagtcttggctcagccctacctcactctctcccaattcttcattcataaagtgccaaaaagattagacctgtaatttgttagccagctttacagggccaggactgagtgagtgcctccttaaactttgtatcctgtgtgcctcccttgccttaccctagtcccagccctgcagctttaagtaattcagacatggattagccatttcccagttctgtctcatacagtccagcctctgccaccttccccaccccttcctttattccatcctaactagttcagccctagtcaagactggatagactgatactgctttgtttcccccaggaaccaaccacccaaccccagtattctggtaattttgacaatgatctatatgaaatttatttgattgacatttagactcatgagttaagcttctgctgaccatttatgttagggtacaatcagaggagcagaaccactaagataaagattatgtatatatgtattttaagggatttattatagggatctgaccgcatgccattgtgggagctggttaaacagtctctgtaaggctgttgtctttgcatctaatgctggagcttgaagtctgcagggcaggcactcgggaagggaagatggatgtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccaggaattagagaagctgaaaggatgatcctggggaaggtggagcagctgcaggcctggctgcaggcctgactactgcccacaccaacgaggtgatctagcagatacatggcaacgtgtgaactgcaacaacgcctggtgccccagcaccaaccttccaagtgtaaaaacaatgtgctgctgcttcacttccgccctccggttatcaagcaaaatgtctcttgtggcccatcttactggaagagagttccgggaaacatagcctcaccaaggtgacacattacaaagccaccctaccatgaatccgctcccaagggtctcactgctcacctgaggataactcaatataactatgttgctgaaaatgcaaagctgaagaccatggatttcatggtgattccagcaagtacagagattctatgaagcccacccagaaaaaacttgctggtcctggctatttttgtgtcatttattcaagtattgagaacctggcctgtggtaggcactgtacttaatactaggatacagaaatgcaaaagatacggcccatgcaattttattaaatgcatcaatatgtattacaaatggtgaatggatttccaactttatcatggaatttaatgctgaatatatagaattcagaaaattgttgggaggacagcccttttgtgaaccttgtttggggcacagtaggaattggaaataatttagtttctatctctaagctgttctattttaaaattatttttaaatttttattgtcccacttaaaaaaaaacttagtgtttcttttgggagtggtttggtgggaacagtgttgactgcctctgagaaactgggatagtgggtgggaagatcaaatcaaggtcacttctttccaaggaccctgagcgattcacttacctaggccgcgggggcggggggttggctgaaggctgaggctcttggtgctcagcactggccggacaccttcaacctgctggtgggtccgccagggggcgccggggcgagaaagcccgtagttcccagccacagtcacccaccggggccctggaggcaccgctcgtcacccatcacccctggcctggccgccctggggcgtggtctccgtccggcgcaaaccccagtacttgggctagggccagagggaagctgagtccccctcttcaaatagtggtaaaacaggcaaaaccgaaccggggttaaatttcggagctcgcccagggtgagggcggggctcgacgacctaggacgttcgagtgcggccgggtgtcgccaagggtcggtttaccccatcgcctcagaaattccgacgaggccctttgggctgcacaaccttgggaatccccaacgggcggccccgaatctgcgccgattttcccaagccgtacttcgggcccaaggcgttttcattgccgccttcccggaggatgtgtggtgggggtggttccgcccggaccgacgggcgggcccggagcccgttggactcgaagatcaaagaaccgcccctctggacactccaggaaaccgagacgaccacctaatttgtttgttttctgtttcaggccacgtaaactcttagtaaatgcaaatgcgtattttactgaactgcaattgaaagaaccgttatagaaaagaacacaaaatgacagaattattaaaagagaagaaaaacattaa

SEQ ID NO: 309548 - DNA, 3011 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggaggcccagtgctctggcctgagttgggttgtggccttaccccaggtgaagcaagagaaggcggatacccaggacgagtggacaccaggcacagctgtcctgacttctcccgtattggtgcctggctgccctagcaaggcagtagacccaggcctgccttctgtgaagcaagagccacctgacccagaggaggacaaggaggagaacaaggatgattctgcctccaaattggccccagaggaagaggcaggaggggctggcacacccgtgatcacggagattttcagcctgggtggaacccgcttccgagatacagcagtctggttgccaaggtattaccaccttgctcttgactggaaatgcaactgtggttaccacctgtgctgcaggtccgtcctggttccctgatttgtgtttcctgttctgcctggatcctgattctcagaaaccagttactggacttctgatccacatcctgaccctggtccactgtgaccctcagactcttaattatgctccaccaggtcgtgccactgccccactagtccatttgatctgcccccatcctaggatatcctgagtctaagccctggtttctgccaatggcaaataggaagattttattaacaggttttaaaaaattattattattactggttatttggtttgacaaggcacttaggctccctgagctttgccttagctggaaaataaggatagtattacttgctattctatcaaccctgtaagatatttgcggccacgcgcggtagcgcaccctgtaattccaacactttgggaggccggcgggaggggcagtggggaggatcgcttgaacccaggagcaggagttccagcctgagcaacatagcgggaccccctgtctcttcaaaatttgtttttaaattagcagggcgtggtggcgcaggctctgtagtcccagatactctggaggctgaggcccaggaggacgaggctgcagggagccatgatcacgccacggcactccaccctgggcgacagagcgagaccttgtctcagaaaaaatctgtgaggttaaaaggctgtgtgtgtgaaaatatcttggaaattgtaaagaactacacaaatataaggttttcctgtgattattaccgtcatcaagattaacctacagatagtgcaaaatttaagcttcccaaaaaatgttcgctaacctttttcatacttttagaccattacaagatataaatagcaaagtcaactggaatt

SEQ ID NO: 309549 - DNA, 1860 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaagcgtgtgggctgtggggagtgtgcagcctgccaggtaacagaagactgtggggcctgctccacctgcctcctgcagctgccccatgatgtggcatcggggctgttctgcaagtgtgaacggagacgctgcctccggattgtggaaaggagccgagggtgtggagtatgccggggctgtcagacccaagaggattgtggccattgccccatctgccttcgccctccccgccctggtctcaggcgccagtggaaatgtgtccagcgacgttgcctacggggtaaacatgcccgccgcaagggaggctgtgactccaagatggctgccaggcggcgccccggagcccagccactgcctccaccacccccatcacagtccccagagcccacagagccgcaccccagagccctggccccctcgccacctgccgagttcatctattactgtgtagacgaggacgagctacagccctacacgaaccgccggcagaaccgcaagtgcggggcctgtgcagcctgcctacggcggaatggactgtggccgctgcgacttctgctgcgacaagcccaaattcgggggcagcaaccagaagcgccagaagtgtcgttggcgccaatgcctgcagtttgccatgaagcggctgctgcccagtgtctggtcagagtctgaggatggggcaggatcgcccccaccttaccgtcgtcgaaagaggcccagctctgcccgacggcaccatcttggccctaccttgaagcccaccttggctacacgcacagcccaaccagaccatacccaggctccaacgaagcaggaagcaggtggtggctttgtgctgcccccgcctggcactgaccttgtgtttttacgggaaggcgcaagcagtcctgtgcaggtgccgggccctgttgcagcttccacagaagccctgttgcaggcagtagacccaggcctgccttctgtgaagcaagagccacctgacccagagaggggcggagcagcagagaggggcggagcagcagagaggggcggagcag

SEQ ID NO: 309550 - DNA, 941 bp, Homo sapiens
ccgctgcggagcgccggcccgtaggcgcgggagcctccctattaagggcacgcgacatcgaggcaatagtgcgcaggtgcttagccagaggcggagcccgagaggcaggcagcggacttccggttccgggagcaacgaacagccgcggaggcgacagctaccgcttcagaggaggcggccgcggaggaggaggaaggggaggagggcgaggcgggaggtgcaggagggaccctcgccatgggtccacgggcctagagtggcggaagataccggcctggtgccaaactggctactgctgcttcctgtggcctccatggctgaggactggctggactgcccggccctgggccctggctggaagcgccgcgaagtctttcgcaagtcaggggccacctgtggacgctcagacacctattaccagagccccacaggagacaggatccgaagcaaagttgagctgactcgatacctgggccctgcgtgtgatctcaccctcttcgacttcaaacaaggcatcttgtgctatccagcccccaaggcccatcccgtggcggttgccagcaagaagcgaaagaagccttcaaggccagccaagactcggaaacgtcaggttggaccccagagtggtgaggtcaggaaggaggccccgagggatgagaccaaggctgacactgacacagccccagcttcattccctgctcctgggtgctgtgagaactgtggaatcagcttctcaggggatggcacccaaaggcagcggctcaaaacgttgtgcaaagactgtcgagcacagagaattgccttcaaccgggaacagagaatgtttaaggtaagcacaacctgcttcctcttcacaactctgcagtgggagcaggatgtgatggagctggtagagtctgaagggatgatgatgggtccacaggatgaagagtcattttata

SEQ ID NO: 309551 - DNA, 2450 bp, Homo sapiens
aggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaaaaaaaaaaaa

SEQ ID NO: 309552 - DNA, 2336 bp, Homo sapiens
aggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccacggggccgccagcacactggaattc

SEQ ID NO: 309553 - DNA, 838 bp, Homo sapiens
gttttgtcttttttttttttttctttttcattgaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaagtgagtaagtttgtcctggaaaactgaaatcttaacgatggagctgatggatgagcagatatgaggaaagacatacataaacatttacatgttgttttgctaagaatatgtggcctagaaataaatttgtatgcttaactcactgtaaaatctttggctggtctttcctcctcctttaatgacaatcatttcctttttttgttctcacctcttgccatcttaactcctaaaatctgaactcactgatttactttttacccattcttctattccactacaatctaacatctctgttagcccattgaaatgcctgtaaaaggtcactaatgaccacctacttccccaaataatggatactcctgaatcatcactaagctaatgcctccaaaatctatctgtatatgagaagaatcatgtcttgttcatctttgtataccctccacctgacacagtgcctggcaataggtgctaaagcaaatgcatgttaagctagcatgtgaaagaatagctacctgtgtctgctcctgagactatctgcatggatgacaaaagtctttaaatggtaggatctacagaagctgtcagaaatgctgatctctgtgtgctgcgtgcccag

SEQ ID NO: 309554 - DNA, 510 bp, Homo sapiens
gttccagtcattgaacaagtccatggagctaaatacaacgatgaccattcttgccaacatttttaggtgcattttcaggaactctatgaaccacaaatctgggcattgagattctgtaggcattagactagcaaggctggtccagtctttgcctatgctgtagactcatcaggggccttcccatgccagtttcctcatctgtcaaatggcatcaaatgggctactactgggagatgtaaggaggaaaaaagtcaaatatcatgagatagactaaggaaataatgctggtggtctcatgctatgtgccttactgatttctctttcagaattggacaaaagtttctcaatgattaaggagggtgattataaccccctcttcattccagtggcagtcatggttactgcattctctgggttggcatttatcatttggctggcaaggagattaaaaaaaggtatgtgagtttaacttcacatgaaaagaacacaactttaaagtgaaaaagaaaa

SEQ ID NO: 309555 - DNA, 2396 bp, Homo sapiens
aggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaattgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaaaaaaaaaaaa

SEQ ID NO: 309556 - DNA, 1961 bp, Homo sapiens
  misc_feature (22)..(22): n is a, c, g, or t
  misc_feature (43)..(43): n is a, c, g, or t
  misc_feature (50)..(50): n is a, c, g, or t
  misc_feature (86)..(86): n is a, c, g, or t
  misc_feature (97)..(97): n is a, c, g, or t
  misc_feature (107)..(107): n is a, c, g, or t
  misc_feature (120)..(120): n is a, c, g, or t
ccaggaggaaccagggggggantggggtggaaattttattttncaagggnaaacaaaggatgccaggccaaaatgggaaggatgangccctgccaanaaaactaaangcagcccttttgnaacaaaagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaaggagaataacaactgaaaaacaaaaacacaatctcttgatcttttcaagtttgaaataagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaaaaaaaaaaaa

SEQ ID NO: 309557 - DNA, 1319 bp, Homo sapiens
gcagcaaccattaataaatgccacctcctacgtcaaacatgaagtgtgtttccttcagtgcatctgggaagatttctacctgagttaattgggaagaagaaaaccatttgtgaatcatctggaatctggtcaaatcctagtccaatatgtcaaagcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaaaaaaaaaaaa

SEQ ID NO: 309558 - DNA, 1772 bp, Homo sapiens
aggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaagtgagtaagtttgtcctggaaaactgaaatcttaacgatggagctgatggatgagcagatatgaggaaagacatacataaacatttacatgttgttttgctaagaatatgtggcctagaaataaatttgtatgcttaactcactgtaaaatctttggctggtctttcctcctcctttaatgacaatcatttcctttttttgttctcacctcttgccatcttaactcctaaaatctgaactcactgatttactttttacccattcttctattccactacaatctaacatctctgttagcccattgaaatgcctgtaaaaggtcactaatgaccacctacttccccaaataatggatactcctgaatcatcactaagctaatgcctccaaaatctatctgtatatgagaagaatcatgtcttgttcatctttgtataccctccacctgacacagtgcctggcaataggtgctaaagcaaatgcatgttaagctagcatgtgaaagaatagctacctgtgtctgctcctgagactatctgcatggatgacaaaagtctttaaatggtaggatctacagaagctgtcagaaatgctgatctctgtgtgctgcgtgcccag

SEQ ID NO: 309559 - DNA, 1289 bp, Homo sapiens
aggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttgcatcacatggcgacgggatcctctaggtcgaggacacagcg

SEQ ID NO: 309560 - DNA, 1103 bp, Homo sapiens
aggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttgcatcacatggcgacgggatcctctaggtcgaggacacagcg

SEQ ID NO: 309561 - DNA, 1909 bp, Homo sapiens
gctttatttaggttttacctgtttgtttcaaagagcaaaaataactccatagaacacttatttatagcgctgttaacaagagctccgaggaagaaataatttcaactatgtttccctagataatataagcaaatatccaaaagagtaaatacatattccagggcagaatcatacatcgctaaaggtcttcagggtttacaataagtaatgtgggcatgtaaaaatttatccccaatggtcaatgaacattactacggattaactctacatcacattgaaatttagtcctcaactctcttcctacaaaacagaatccacagtagttggccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagcttta

SEQ ID NO: 309562 - DNA, 8079 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309563 - DNA, 7754 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309564 - DNA, 7685 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309565 - DNA, 8025 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggcgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309566 - DNA, 7585 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggagtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309567 - DNA, 6502 bp, Homo sapiens
ggtcctacttttcacaggggctgtgacccagaagagttagaatcacaatttcttcatgctacagagaggaaactgaggcctagatgtcatttgggacccttcacaaccattttgaagccctgtttgagtccctgggaaaagtagggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309568 - DNA, 8025 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttccataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309569 - DNA, 6875 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309570 - DNA, 8641 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaaaatagtgcttac

SEQ ID NO: 309571 - DNA, 8188 bp, Homo sapiens
  misc_feature (8188)..(8188): n is a, c, g, or t
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaaaaaaaactcgagcaagcttatgcattgcgcccgaattcgagctcactgggcaattcgccctatagggaggcgaatacaattcactgcccggggttttacaccgccggcn

SEQ ID NO: 309572 - DNA, 8000 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309573 - DNA, 4315 bp, Homo sapiens
cagaataaacagcatcttcaaaatccccctttctcataccttcttattaatggttgaattagtatgtctctgtcatctgagagtcttgcatcttgaccattacctttattttctgtcaagggaatccctagaagatgtatggggagacataggaaaggaatggaagaaagttaattcaccccaaattggataaattccatgacatttagcaatatacttctgtatccctagaattgtatcataactttagttcaaggacattgcatctcaggtgggttaaggaggttgggaaggggagaaaagggatgaggagatattttcttgagatttatctccttgagataatgcttgagaagtcatccagccatggacttcttggagtaatacttacaaagaattggatgcattttgcatccttaggcaaaaaccccagtgctgttacaactgaaaatcattagccttgttctctgatagatacttacaagcccaactgcaggcaatcaaaatttatagcagatgagttctaactccatcaacctgtaatgtggtccatcttagggaaagaataggaaaacaccttggtttaccacaggctttgcttacagtttctgctttctgtgacctattttttgtatttcagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309574 - DNA, 8197 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaactacttcaaatcctgtagtagcctactgagtgagaaaacatattctgaccatgggattcaatcagaggcacagtgaactcctcatagcatcttcttgggattactcagggacccagaacttttacgccaatgtagaatctaccgaggaggtccctttacttaaggattcacagggtggccgattccaaaaggtccttggaactcaggcatgggcgccatctaaacgggtcaagggggagtacctttggaacgtgaccccagaaagaccggcaaaacaagggcgcccgcaaatctcacgggcg

SEQ ID NO: 309575 - DNA, 4061 bp, Homo sapiens
aactctgcatcgtcatggtggcttggggctgtccggcgtgggagaacgtcgatacggagatattttcttgagatttatctccttgagataatgcttgagaagtcatccagccatggacttcttggagtaatacttacaaagaattggatgcattttgcatccttaggcaaaaaccccagtgctgttacaactgaaaatcattagccttgttctctgatagatacttacaagcccaactgcaggcaatcaaaatttatagcagatgagttctaactccatcaacctgtaatgtggtccatcttagggaaagaataggaaaacaccttggtttaccacaggctttgcttacagtttctgctttctgtgacctattttttgtatttcagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309576 - DNA, 7782 bp, Homo sapiens
  misc_feature (7732)..(7732): n is a, c, g, or t
  misc_feature (7774)..(7774): n is a, c, g, or t
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactatcttcctttaccancgtggtgaccctaaggggacttccttacacaccttggaactnttccgagc

SEQ ID NO: 309577 - DNA, 7700 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctgacgcgccatcgtgcgccttcggggatcctctag

SEQ ID NO: 309578 - DNA, 2036 bp, Homo sapiens
  misc_feature (39)..(40): n is a, c, g, or t
tacgaccgagctataccatgtccctagcgtcatatccanntagttgtgcccctggatccaaccgtgctgaagctagaatatcccctggacttttcagttatgtgaacaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309579 - DNA, 7372 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtagcatagactcctaaacagaacctcaagtctgattgaggataaggccttctcctgagctgaaagttctttggcagatgagcaagaaactgaaagctgatgtacctgactggctctgtaagatcagaaaactgtatccagaataagccctatggattaacccctgagtacccagagtaaaaactaatttacagaacttccttattgatctgctggttcttccagatcatattctggctattggtatggctggcctttctgaaggtaccctgcttgtctattttcctgactcagctcttgcctgcctttttcacatgttgctgcaattagactcaccgtgaggactacagtcaatttcagtctatcttgtgcccaatacaacaaggatttttaatagtaacaacccacacctcacccactaggactcaatgttcacaacaggaaggaccattgctgcatactccttgaccagcaacttttttgaagatatttttaagtgcagagtaggcctctattcctgtatgtaattgttcattttcagcacctggaacctcatctatcgggtctggaaggaatacagcagttcgaaagccgcgtccatttctctccttcagtagtgcagaaatgagtccgattcaccagtacacacagaactgtaccagttcaacctagcgaagaccccaaaagagcgaaagaccccgaaagagcagagacccaaaaggggtccgagct

SEQ ID NO: 309580 - DNA, 4974 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgtcctgtgcctcctgattgctgagtgttcacctggaccttctgactaccttccctgtgctattccatcagcctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagcttta

SEQ ID NO: 309581 - DNA, 6895 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtacaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309582 - DNA, 6700 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataaaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaactttcagctcaggagaaggccttatcctcaatcagacttgaggttctgtttaggagtctatgctacatctgggagtgacagggtcagcagagccagatttgtcaaagttggc

SEQ ID NO: 309583 - DNA, 5031 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatgatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagcttta

SEQ ID NO: 309584 - DNA, 6275 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactttgaagtcttgaccctccatgaatacctgaattatcagcaagcgggttttgaagctggtgcctcattgaggccatattagagcaacttgtacatttgacctcttgttatcagccatggtactctacttcgtgtgcaagagataactatgaaagccaaattcaaatactggcaacatttcctaaaggggctcaatatctatcattcgtcttcttttccaaactacacatcactgtatgactcaaccagtagcagttatattgccccttggtttttattcagtttaactactgtttccaagataaatgagctaataagctttaaaaaaaaaaaaaaaaaggctgaattcttttttcttcatcactggcatatctgcctattctccagaattattatgactattcagctcactttaacagttgaacttcaagcgacaatctttgaacaccccttctcatgtgatttaaaatgaaaccatttggaaaagtttcttctagccagtaatagattttttttttaattgctctgccttgtgccgagagatgttcttttaagatgaatcttttgatgtctgataccaccaaatataggtggtagggagagttggaggctggccctttgagcaggccattagcttacttgctgggcatttccgatagcttattgcctacctttttgctggaaacaaactgatttgaaaaacaaaatctatgaagactgcagctaaggattttatcggtagacttaagagcttttgtccttgtggatattttagtggaaccacatcagtctcaatactgtcattttacactgactcagagcagctgacttcattccttgccatgatatatatttaaggcaggcattgtaacagacataaagacaacttatctgtttcagcaggaaggattcagtttatgaactctcagaccagatcatgttgaacaaggagactttgatgtgtgtcatgagaaaactcattctttacttcccagtcaatttaaaggccagctatcctgagctactcgaatgaatgcactggttaaacattggaaatagtttgtttatatccttgtctctctctaggccaattgtgattacatgactcgactctacatctcgtcaaacaaggcctaggtctggttgctgtagactgctcgccctcaacaaataacaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309585 - DNA, 920 bp, Homo sapiens
tacaggactcgacacatagaatgcagcagaacctcatctatcgggtctggaaggaatacagcagttcgaaagccgcgtccatttctctccttcagtagtgcagaaatgagtccgattcaccagtacacacagaactgtaccagttcaacctagcaaaagaagaaaagtttccactgtacttaaaatttacagctgactcaaattgcctcacagaattatttgatgtagaaggctagttgtcttacttcagatcagcaggacagttgggctctcagactcatgaccactgagtttgcttgtgttgaaactgtggtttcatccaacatatgctattggacatgattattattccattcaaatggattacagacttcttgaggacaggacaaacttatctctcatggtgtttttttagaatacttttataaccaaggaagaaaccatgccagctgttaccattcaacttcttaagcagagattaagctttttcatatctgttcttatcctggacatcagtagtttttaattgcccagcatccgttccatcttgtaacaactccctgatgtttcttaaaaccacctcttcctattttcagtctgtggtttggacagtctgacccaaccttgagctttgtgggtgaacatgtaattcagacctcatcaatcagcaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaa

SEQ ID NO: 309586 - DNA, 5035 bp, Homo sapiens
gcgcaagttgcagcttcaccacctcccaagtgaaaaagctcctaggcactcacgatttcttttttcaaagccggaccaaacccagttcagggtggtggtcagattacctcacacttggcccacataaacacctcacaaatgacccgcccacagcacctcgggcaggccgcgccccgcccccacgtccctcagacaacagcctcagcctcccaggcccttcccgggcctcggtcccgtggccgcctccccacgaagaggagctactcccggcttccaaggaccggatcgagggcagtggcgagcgcaccacctgaccgggcactacccggatctcacaactgcctttgtccctccccgcggaattggaacccaacagccgcagagcgctcttggaaccatgtgctgctgccgcctccgccgccgccgccgctgcctccgccgccgcccgcgcgccgcccgcgcgccgcgctagttgagatggtgacaggattcagcaacacgaaattcggcgtttagagctgctctgccgccgccgtcacagacaccacagccaccgctttgtctccgatagtgcacacagccccggccacctcgcacactccccgacgccccaagcccccgaggcctccgcggagcattcagccaatcacaaagctgcagctcctcccgcccccgccctgatgtacagcctcctgattggcgggctgcgtgtccccatgtgaccggatcttggttggccggtcccgcccctgtcacgtgacagcgtgcgcctctcttcctgctttcctgaccctctccgccatttaaagaaacagtaccgggggcgggccgagcgacgcagccgggacggtagctgcggtgcggaccggaggagccatcttgtctcgtcgccggggagtcaggcccctaaatcgaagaagccctggcgcgccctccccccctcccgggtctggtagggcgaaggaacgggcgtgcggtcgatcgagcgatcggttggcggctctttctcctgctctggcatccagctcttggggcgcaggcccggccgccgcggcgcgcgcccggtggccgttggcgctcgcgccgcgtctttcttctcgtacgcagaactcgggcggcggcctatgcgtttgcgattcgacgaggagtcgtccgggtggtcggcggcggcgggcagctgctccgccccgctccgggggaggcggcggcggcagcggccgcgggatttggagcggccggggaggcgggggtggccggggccggcttggaggcctggcgccacccttcggggcctgcaaggacccagttgggggggcaggagggggccggaggatggttggttgtgggatttctactttgccttttcctccttatgccgccttagtgaggggcgggagctctggcggcagccccggggtggggagacgagctccggagtcggaagagctgggttttcttccgggcctagccaccagttggcggagtgaccttaggcgagtcactctgtaatttgtctgcgcctcagtttcctcctctgcctatcaatgtgtgtggggttgaaatcgctttgtaaactataaagcgtgggtgtacgtaaaggatggttattgtttataattttttttgagttgtaagaaaacttagcagttccccaatccttgggttttgaacctgggaaccttggattggagttggggatccccaaacttcctgaaattgtgggaatgtgcggtttgggggaatgatgggaatttgtgggaatgtgcgttttaggggaatgatgatccatcgctagcaagttttccaagggggctgtgacccagaagagttaagaatcacaatttcttcatgctacagagaggaaactgaggcctagatgtcatttgggacccttcacaaccattttgaagccctgtttgagtccctgggatatgtgagctgtttctatgcataatggatattcggggttaacaacagtcccctgcttggcttctattctgaatccttttctttcaccatggggtgcctgaagggtggctgatgcatatggtacaatggcacccagtgtaaagcagctacaattaggagtggatgtgttctgtagcatcctatttaaataagcctattttatcctttggcccgtcaactctgttatctgctgcttgtactggtgcctgtacttttctgactctcattgaccatattccacgaccatggttgtcatccattacttgatcctactttacatgtctagtctgtgtggttggtggtgaataggcttctttttacatggtgctgccagcccagctaattaatggtgcacgtggacttttagcaagcgggctcactggaagagactgaacctggcatggaattcctgaagatgtttggggttttttttctttcttaatcgaaagttaacattgtctgaaaagttttgttagaactactgcggaacctcaaaatcagtagatttggaagtgattcaaagctaaactttttccttggccctccttgtgttctaattgcttgcaagtgtaatactaggatgtccaagatgccagtttttgcttctttgttagttgtcagctgcttttatcaaatttcaggccattatccaacaaacactataaaaatgtttgaacaattggatttcaaacattttcgttttgtggagtggtgctcaccaagtggtacagccctaagcaagtgaacacaaacacatttaagtgtattttgtctgattagatgttagccagttatgctatttcattcaaatgtctgaaaaaatcaattgactattcccttttcctaaagggcagagacagataatctcacttccagagaaatgacttggagaaaaaaaagtgttggtctttttgctcttttgtaattaaatccggatgtacctcaaaagacttaagactgtggtgataagatgctttcctcagcagaaaggagggaaaaaaaacaactggaactcaaagcttgaaattctgtggcaaaacatgagatgtccaggattggaggttgaaaagatttcactacagtgttctgcaatagttggagcagataactttcagtgtagccacagccatggactccagatttccagattttcaagacctggacctggaacccgaaagagcttgtcacgatgcggcaggaacactggaggtagatttttttttatttttgaattttgggactgttgaccttgctgtgagaaaagagacaacgactgagcaagcactaccaccagcactgttactgggaattagaagacctgagtttctgtccagaccctcagtgcaaactgaggatgctccatccaaagtgaattatggtacttgccattttccaaaatgccttatcctttaccatctctgcacttttgttcatactctcattctactttggaactgctgctctgtggcttttcatctgtcaaaactgccattttctcagtatccaactcttatgccctcttttccatgagtctcctaactagccagaatagagctttaaagttttatgacatttcgttatgtatcctctatctgtatacaaaatcctgtaaaatagttacttgcctgcatttactgtctttgcagatagcagactccttgaaagcagggtccttgtttagtgcatctttgcccacatacaccacaacttatcaagatgcatttattaggaaggaggagtttagagagcaggctatcagaataaccacttcacctacagacctggtacctggatttttgcccgagatgattcctaccaccttactactgacgaagacacccattccagtggaccactgtgacccaggaggcattcagccatcatgatgtggcctttacctccactcctgtcttgttctacccagattcagcacagccctttatagtgaagtcagagtcctcaagccaaatagctaaagctgttttatcacaacaaaggcctagtttgttccatgagtgtgcatttcatttcttcagttaaagccttcagagacacacaataaatttggaccaggggattttttagttattaatgctctctgaagaaaggcaacatctttttgagagcagcattggaccacaccccacaatctcaaatgattgaaattcatgaacatctaggatcccatgaaggtcactggaccctgttttttctacttcaaatcctgtagtagcctactgaatgagaaaacatattctgacccattgggatcaaatcaaaggcacagtgaactcctcatagcatcttctttggaattactcaggaaccagaactttttacacaaatgtaagaaattctaccaaggagtccccttacctaacagcatctcacaaggctgcaccagattccagaaaaggcttctcttgatacatcaagcattttgtgaccgacttattcttagatcattggttttccaaaggctttgtggccatgaagccctttgagtgaaaactgtgcagaagcccagagtaaaagtgaagctgctctggatgaagtagtgaagcaagagtaggggcctgaatcctgctacaactatcttcctttaccaccgtggtgacacctaaggggacttccttacaacaccttgaactcttccgaacacagtttgaaaaccactgccccagacagcaatatgtttgacctgaatggcattccaatcttttctgtacctccactcagcacagttcatgttcagtagatgctgaacattcttagaaatactgtgtgtgaacttagaaaagtgcaagaagacaggcatgtctttgaccccaggaatgatcatttgctgaagatggtgtcaagtgaacctagattaacagccctccactccagatggatatccagtgattcctagaatgggatatagccagagaacaattctatgcaccctacactgacagactcccttaagcaacaccagatgctctactggtacttgaagtacatgactcctcccccttatactaatagctagccaatcccacctatcaaaagaaatcacaacccg

SEQ ID NO: 309587 - DNA, 1414 bp, Homo sapiens
  misc_feature (39)..(40): n is a, c, g, or t
tacgaccgagctataccatgtccctagcgtcatatccanntagttgtgcccctggatccaaccgtgctgaagctagaatatcccctggacttttcagttatgtgaacaatctggttgactagcctccttgtatatacaactattatttgttaagaagaaattatcgtcaattttctactaccttccaattgtcagctctttttttcctctctggtttttcctatactttacagaaaaagacattgatctatactgccattccctctaatcctgccatactcagtcaaaaggaatgacttaagatgaagatgatcatctgctcgagtctaaaatatacattgtatataagaattggtgattagaaaagcaaaaaacctaaaacttaaatctaggagtctgtatactgtctccatgtctccatgcctcagatctcatctaaatctttgaacagcaccattcaaccaatctgaggccttgacttgcttgtaagatgattctcagagatcggctgagttaaaaaagatgacgacttgattaccaaagaaagtagggccaactttgacaaatctggctctgctgaccctgtcactcccagatgtacaaatccatctgaactgtggaggagaagctctctttactgagggtgctttagctttgtaggatgaaaacctcaaactaacagggcctaccatgtagagaatgaagccagtgcaggggaaagcagagccaaaatatggagagacttgaatcctgatgacagcgtttgtgcccctggatccaaccgtgcctgaagctagaatatcccctggacttttcagttatgtgaaccaataaatacccttttttgcttaagttactttgagttgggtttctgttacttgaaattgaatccacactaatatatctaccaacattgagacttgacagatccaagtatttattaagctagaggtcatggtcactgaaattactttccaaagtggaagacaaaatgaaacaggaactgagggaatatttaagatcccacagaagcgtaaaaatgacatggtagaaagtaatagaaaacctaaatgtctgtcattaaaggataggttaaggtgtggttcagccatataggaatatctcgtatctgttaaaatgaataaagtacattcattgtgtatggaaaaatggccatgatacattaggtgaaacaagttattaatagaaaagtgtacagtgtgaactcattttaaaatgtgtgtgcttatgtttataaatgcatagaaaggtctattcacagctttctttgaacagtgtagatcacatgaaactttcaactttatacatttctgtattaatattttacactacccacattatttttaaactttattttaaataaagaatttttaaaattaaaaatagtgcttac

SEQ ID NO: 309588 - DNA, 1972 bp, Homo sapiens
aggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctga

SEQ ID NO: 309589 - DNA, 1818 bp, Homo sapiens
gaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctga

SEQ ID NO: 309590 - DNA, 1084 bp, Homo sapiens
aggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagagggaccatgaccttgggctcccccaggaaaggccttctgatgctgctgatggccttggtgacccagggagaccctgtgaagccgtctcgggccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtcctctcaggcctagctcagatgatgcgggagtgctggtacccaaacccctctgcccgactcaccgcgctgcggatcaagaagacactacaaaaaattagcaacagtccagagaagcctaaagtgattcaatagcccaggagcacctgattcctttctgcctgcagggggctgggggggtggggggcagtggatggtgccctatctgggtagaggtagtgtgagtgtggtgtgtgctggggatgggcagctgcgcctgcctgctcggcccccagcccacccagccaaaaatacagctgggctgaaacctga

SEQ ID NO: 309591 - DNA, 2330 bp, Homo sapiens
gaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtgaggcctctgctgggactaggatggcgtggggtggtggctcatggctgggatttctgggcccaggaacttgtgtctgaggcctctgcttcatctcatagatactgagtgtcctggttagggcacctctctaggtactccctctttcaaccctggcccatgctccctgcccccagggccatctggtcattctgggattttaagaaccttcaccttccctgtgaaaagtcagaggctatctgtggctctgtctgtgtgtgtgtgtgtgtgtgtgtgtgtgtgtgtgtgtgtttgagagtcagggttttgtttgctcttgtcacccaggctggggtgcagtggcacagtcatagctcactgtaacctcaaactcctcggctcaactgatcctactgcctcagcctccccagtagctaggtgtagtgcacaccaccacacctggctaatttttaaaattttttgtagagacaaggtcttttatgttgctcaggcttatctcaaactcttgggctcaagtgatcctcctgcctcagcctcccaaagtgttgggattataggtgtgagcctccacacctgaccactgtggtatttttgttgctatttgtctttgtttgttgctgttttgttgttgtttgtccttgttttttctcaaaacacttcacttgtacaaagacacacacacgtatatcaacacatacaagcgtgaatatccttctgaacatacactcacagaaatatacacatgcgcatatatgccagactgttggccccgtgaggacaaagaacgtgtcttttgctcacccttatgtccctattacctatca

SEQ ID NO: 309592 - DNA, 1904 bp, Homo sapiens
gaggcggcctccctgcctcccctccaaaaaaaactctgtgatttcctctgggcaggagggagccacggccagcggctgtcacacttcatggctcttactccacctctcttgctcctctctgcagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgttgctcagacacgacaacatcctaggcttcatcgcctcagacatgacctcccgcaactcgagcacgcagctgtggctcatcacgcactaccacgagcacggctccctctacgactttctgcagagacagacgctggagccccatctggctctgaggctagctgtgtccgcggcatgcggcctggcgcacctgcacgtggagatcttcggtacacagggcaaaccagccattgcccaccgcgacttcaagagccgcaatgtgctggtcaagagcaacctgcagtgttgcatcgccgacctgggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtgaggcctctgctgggactaggatggcgtggggtggtggctcatggctgggatttctgggcccaggaacttgtgtctgaggcctctgcttcatctcatagatactgagtgtcctggttagggcacctctctaggtactccctctttcaaccctggcccatgctccctgcccccagggccatctggtcattctgggattttaagaaccttcaccttccctgtgaaaagtcagaggctatctgtggctctgtctgtgtgtgtgtgtgtgtgtgtgtgtgtgtgtgtgtgtgtttgagagtcagggttttgtttgctcttgtcacccaggaggcggaggttgcagtaagctgagatcatgccactgcactccagcctaggtaatagacccaatttaaaaa

SEQ ID NO: 309593 - DNA, 1098 bp, Homo sapiens
  misc_feature (1059)..(1059): n is a, c, g, or t
aggaaacggtttattaggagggagtggtggagctgggccaggcaggaagacgctggaataagaaacatttttgctccagcccccatcccagtcccgggaggctgccgcgccagctgcgccgagcgagcccctccccggctccagcccggtccggggccgcgcccggaccccagcccgccgtccagcgctggcggtgcaactgcggccgcgcggtggaggggaggtggccccggtccgccgaaggctagcgccccgccacccgcagagcgggcccagagggaccatgaccttgggctcccccaggaaaggccttctgatgctgctgatggccttggtgacccagggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccgagttcgtcaaccactactgctgcgacagccacctctgcaaccacaacgtgtccctggtgctggaggccacccaacctccttcggagcagccgggaacagatggccagctggccctgatcctgggccccgtgctggccttgctggccctggtggccctgggtgtcctgggcctgtggcatgtccgacggaggcaggagaagcagcgtggcctgcacagcgagctgggagagtccagtctcatcctgaaagcatctgagcagggcgacagcatgttgggggacctcctggacagtgactgcaccacagggagtggctcagggctccccttcctggtgcagaggacagtggcacggcaggttgccttggtggagtgtgtgggaaaaggccgctatggcgaagtgtggcggggcttgtggcacggtgagagtgtggccgtcaagatcttctcctcgagggatgaacagtcctggttccgggagactgagatctataacacagtgtttgccccaagaacacgaacaaacaatcncctaagggctttattccggccttcaagaaccattggacc

SEQ ID NO: 309594 - DNA, 1476 bp, Homo sapiens
ggagaaaggaggcaggagccaggaacctgggttctcatcctggtttcgccagcctccaggtctgctctgtgaagtgggctcataatgcctgccttgcccactcacatctcgctgggttcttgggaacctagagagcactacacaagcaaagagtacctggggccatggttctctctgtggccactgccttccagcccatctccgtgcacgtctccatctgccttcccctctctgtcccactgtttctctcagtccccaccttgcctgccccctggatcccaggtttgggagaggggcaggagtgacaggcctcacccccacaggcctggctgtgatgcactcacagggcagcgattacctggacatcggcaacaacccgagagtgggcaccaagcggtacatggcacccgaggtgctggacgagcagatccgcacggactgctttgagtcctacaagtggactgacatctgggcctttggcctggtgctgtgggagattgcccgccggaccatcgtgaatggcatcgtggaggactatagaccacccttctatgatgtggtgcccaatgaccccagctttgaggacatgaagaaggtggtgtgtgtggatcagcagacccccaccatccctaaccggctggctgcagacccggtgaggcctctgctgggactaggatggcgtggggtggtggctcatggctgggatttctgggcccaggaacttgtgtctgaggcctctgcttcatctcatagatactgagtgtcctggttagggcacctctctaggtactccctctttcaaccctggcccatgctccctgcccccagggccatctggtcattctgggattttaagaaccttcaccttccctgtgaaaagtcagaggctatctgtggctctgtctgtgtgtgtgtgtgtgtgtgtgtgtgtgtgtgtgtgtgtttgagagtcagggttttgtttgctcttgtcacccaggctggggtgcagtggcacagtcatagctcactgtaacctcaaactcctcggctcaactgatcctactgcctcagcctccccagtagctaggtgtagtgcacaccaccacacctggctaatttttaaaattttttgtagagacaaggtcttttatgttgctcaggcttatctcaaactcttgggctcaagtgatcctcctgcctcagcctcccaaagtgttgggattataggtgtgagcctccacacctgaccactgtggtatttttgttgctatttgtctttgtttgttgctgttttgttgttgtttgtccttgttttttctcaaaacacttcacttgtacaaagacacacacacgtatatcaacacatacaagcgtgaatatccttctgaacatacactcacagaaatatacacatgcgcatatatgccagactgttggccccgtgaggacaaagaacgtgtcttttgctcacccttatgtccctattacctatca

SEQ ID NO: 309595 - DNA, 226 bp, Homo sapiens
gctgggaccacagtggctgagcttccggtgtgtcttccaggagaccctgtgaagccgtctcggggcccgctggtgacctgcacgtgtgagagcccacattgcaaggggcctacctgccggggggcctggtgcacagtagtgctggtgcgggaggaggggaggcacccccaggaacatcggggctgcgggaacttgcacagggagctctgcagggggcgccccaccg

SEQ ID NO: 309596 - DNA, 2595 bp, Homo sapiens
agcggggagtgcgcccggagccggcgccgcgggccgagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagatccagatgtgggtgcggaaacagtgtccaggaagtggagaagaggcagtgacccttgtggaaagcttgaagggggacccccagagactgtggcaatggatcagtatccaggttctaggacaggacatcttatcagagaagatggaatctccaagctgccaagtgggggaagtggagccccatcttgaagtggtgcctcaggagttgggacttgagaattcatcctcagggcctggggagcttctgagccacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggcaggcatttcccatcccaaatctgacctgactaattcaatagaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccctataaatgtcctatctgtgagaaaagtttcattcagagatcaaactttaatagacatcagagggttcacactggagagaaaccttataaatgttcgcactgtgggaaaagtttcagctggagctcgagccttgacaaacatcaaagatcccacttaggaaagaagccctttcaatagccagtaaccaaactctctttccccatttctatctcccagcccagtcacaaaaatactcagctccatcaagaggaattgtgtctaagaggatacccctgttaatctccttttttcttggattggagaggagagaatctggacatggctttggacttggaggatatcttggattggattgcacaatggcttaaattcttgattctgcctcaggagaaagaatagtcttcatgtttccactcatccttcctttggacccatcggggaaaaagtctaaattggagatccagttttagaagtgctttctgggaagcatttaatgggattagctgtagtcactgcttatgggaagaacctcagatcagccccttaaaatgagttctagagcaggtcttctgttccagaaggggagaagcatagagggcctgtgagctcacgtgtgttctttgtcataggggtgaaaaactaacttcaagtgtcccttgtttgaaataaacttagcagagtcactttctatcttatttgtttgttcactgtgtgtttgactgtatttcaaagcacattatttcatagaagaccctaggcagttgaactccaaagtcagcccctataaacctcaagttcataatgtagcagaacagtaataggaaagtcctaggctaatgttcagacgatcggagcttggccagtgctggcaacacctttatctcagtgcctactcagctgtgaatcctctgaagttcattttttcatatcaatattgtatttttcatctctataaattccatttgcgtcttttaataaatatcttacatgttctacattatact

SEQ ID NO: 309597 - DNA, 2553 bp, Homo sapiens
agcggggagtgcgcccggagccggcgccgcgggccgagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagatccagatgtgggtgcggaaacagtgtccaggaagtggagaagaggcagtgacccttgtggaaagcttgaagggggacccccagagactgtggcaatggatcagtatccaggttctaggacaggacatcttatcagagaagatggaatctccaagctgccaagtgggggaagtggagccccatcttgaagtggtgcctcaggagttgggacttgagaattcatcctcagggcctggggagcttctgagccacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccctataaatgtcctatctgtgagaaaagtttcattcagagatcaaactttaatagacatcagagggttcacactggagagaaaccttataaatgttcgcactgtgggaaaagtttcagctggagctcgagccttgacaaacatcaaagatcccacttaggaaagaagccctttcaatagccagtaaccaaactctctttccccatttctatctcccagcccagtcacaaaaatactcagctccatcaagaggaattgtgtctaagaggatacccctgttaatctccttttttcttggattggagaggagagaatctggacatggctttggacttggaggatatcttggattggattgcacaatggcttaaattcttgattctgcctcaggagaaagaatagtcttcatgtttccactcatccttcctttggacccatcggggaaaaagtctaaattggagatccagttttagaagtgctttctgggaagcatttaatgggattagctgtagtcactgcttatgggaagaacctcagatcagccccttaaaatgagttctagagcaggtcttctgttccagaaggggagaagcatagagggcctgtgagctcacgtgtgttctttgtcataggggtgaaaaactaacttcaagtgtcccttgtttgaaataaacttagcagagtcactttctatcttatttgtttgttcactgtgtgtttgactgtatttcaaagcacattatttcatagaagaccctaggcagttgaactccaaagtcagcccctataaacctcaagttcataatgtagcagaacagtaataggaaagtcctaggctaatgttcagacgatcggagcttggccagtgctggcaacacctttatctcagtgcctactcagctgtgaatcctctgaagttcattttttcatatcaatattgtatttttcatctctataaattccatttgcgtcttttaataaatatcttacatgttctacattatact

SEQ ID NO: 309598 - DNA, 2766 bp, Homo sapiens
gggaaatggtggctgtttagatacagtatcagtagtttgctttgtggcttcaagtttataatctttcaaaatagaatcgtgtatccattgagcaatttcaaaagctccatagttgaccccatggcttctcgggtagggcatgtgaatttgttctttctgaaaatgtgtccccttcctctgtgtagcactcaatctcattccctttttagtgtcctggtgaagacctagttcttgccggagacaattccactgcagaagcactttacttaaaaggacttgccaggctggacaatgcccgttgacttggggcaggccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcaacttcggaagctctgtttccagtggctacagccagaggttcacaccaaagagcagatcctagagatcctcatgttggagcagtttctgaccatcctgcctggggagatccagatgtgggtgcggaaacagtgtccaggaagtggagaagaggcagtgacccttgtggaaagcttgaagggggacccccagagactgtggcaatggatcagtatccaggttctaggacaggacatcttatcagagaagatggaatctccaagctgccaagtgggggaagtggagccccatcttgaagtggtgcctcaggagttgggacttgagaattcatcctcagggcctggggagcttctgagccacatcgtgaaagaggaatctgacacagaagcagaactagccctggctgcctcccagcctgcccgactggaggaaaggctgatcagagaccaggacctcggagcctcactgctcccagcagcacctcaggaacagtggagacaactggattccactcaaaaggagcaatactgggatctcatgctggagacctatgggaaaatggtctcaggcaggcatttcccatcccaaatctgacctgactaattcaatagaatttggggaagagctggcaggaatataccttcatgtcaatgagaagatcccaagacccacctgcataggagatagacaagagaatgacaaggagaacctaaatttggagaatcacagggaccaggagctcctgcatgcttcctgtcaagcttcaggagaggttccttctcaggcttccttgaggggcttcttcactgaggatgagccaggatgctttggagaaggagagaatctccctgaggctctgcaaaacattcaggatgagggaacaggggaacagctgtctcctcaagaaaggatttctgagaaacaactaggtcagcatttgcctaatcctcattcaggagaaatgtccaccatgtggcttgaggagaagagagagacctcccagaaggggcagccaagagcccccatggcccagaagctccccacctgcagggagtgtgggaagaccttttataggaattctcagcttatttttcaccaaagaactcacaccggagagacatactttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccctataaatgtcctatctgtgagaaaagtttcattcagagatcaaactttaatagacatcagagggttcacactggagagaaaccttataaatgttcgcactgtgggaaaagtttcagctggagctcgagccttgacaaacatcaaagatcccacttaggaaagaagccctttcaatagccagtaaccaaactctctttccccatttctatctcccagcccagtcacaaaaatactcagctccatcaagaggaattgtgtctaagaggatacccctgttaatctccttttttcttggattggagaggagagaatctggacatggctttggacttggaggatatcttggattggattgcacaatggcttaaattcttgattctgcctcaggagaaagaatagtcttcatgtttccactcatccttcctttggacccatcggggaaaaagtctaaattggagatccagttttagaagtgctttctgggaagcatttaatgggattagctgtagtcactgcttatgggaagaacctcagatcagccccttaaaatgagttctagagcaggtcttctgttccagaaggggagaagcatagagggcctgtgagctcacgtgtgttctttgtcataggggtgaaaaactaacttcaagtgtcccttgtttgaaataaacttagcagagtcactttctatcttatttgtttgttcactgtgtgtttgactgtatttcaaagcacattatttcatagaagaccctaggcagttgaactccaaagtcagcccctataaacctcaagttcataatgtagcagaacagtaataggaaagtcctaggctaatgttcagacgatcggagcttggccagtgctggcaacacctttatctcagtgcctactcagctgtgaatcctctgaagttcattttttcatatcaatattgtatttttcatctctataaattccatttgcgtcttttaataaatatcttacatgttctacattatact

SEQ ID NO: 309599 - DNA, 2613 bp, Homo sapiens
cttcaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaaactgcaaataaaccccagaacagcgttccagagcaacctctccctgtcaactgtgtttctgagctgaggaagaggagcccatccatcgtagcctccaaccaaggaagggtgctacagaaagccaaggaatgggaacatgaagaagacctaggaagaggatgaggatttcattccaaaggaaataccagcttgtccacctgaggaagaaatgcttttttcacaaggagacaccaagagaagactaggaagtagccctcgttctccagggcacccaaaataccagcctttattgtctgcatgattttaggggatatggggagggaacaagtagaagggaagagggaaatggagagcatccttatgactttacaaagggtggaaatgaggatggagggatacagaagtctgcacagctgtaaaggttttatagatgtctttgccttcccttctgaggaagggaagaagtaatgaaagcacatgtgaataaccccttccatcccattcacagcatcgcactcccagtccttaaggcaaagggaggcagtgctgaagcattggtggtgcagtgtaaagagacaagacctgatcatctgatcacacttgtgccaacttgattcatattgggcattactaacaacccctgggcaaggtaaataggttgaacaatcaataacattatccctgcctgcatacatgtgaacaaaagctatagaggacatgcaaattctacagtcattcctcatatgctttagacagagtgcagctactggaatcttccagatttcagtgttttaaaatcagagctctgaatacacaaaaggaaagagaaatggagcagctgacatattttaagctcacagtgatactcagtgacaggagcacagagctctaatgtccacaggatgttgtagggtagggtctctcagtaaatcaagtcccttacctatgttctgacactgaggctcttggagctatgggttagaaatccaggaggcaatatgtctttattctaatgaagtcctcatcttgcactcagaggcccactagtttgcccttctatatattaagtaaaaccaagagaaattaagaggatgatggcttctttctgtcacatgggtgctaaaccttttacaaacacttgatacttctatagagggaccaaggacctcaagtcctgggcagtctccttactgtgctactcactactgtctcaacactgtagtgagtctgtctttaacacatttccttccaataaagataaaaccacttaactcttaagtgccagtgcttagctcaagaggaaagaaggaaaatcccagaataaccgtggccactttgctataggggttacatattttaacccacctaaggttttacagactttagcctcactcaaactttatcaccctctgaggtagctggagaccacagcaggaaaaataacctgaccagtaatcacccactgattagtggcagagcgtaggacttaggggttataagcccagatccagatagggctaggtttgagccatgcctctaatgaccagctgggtgaccttgggaaagtcacttgattgctctgattcttgttttccttatctgtgaaatgggactaacaattgttacttttctcccaagattgttgggaagatttaataagataatatatagtaggcatcttgcatagtgtctgagaaataagaaatgctcagtcaatagtggctctcattagccaggcatggtggtactcgcctgtagtcccagctactcaggaggctgaggcaggaggaccgcttgagcccaggagtttgagactgtagtgcactatgatcacgcctgtgaattgccactgcactccagcctaagcaaatagcaagaccccatctattaaaaaaaaaaagtggctattattagctatatcagaaatgt

SEQ ID NO: 309600 - DNA, 1954 bp, Homo sapiens
cttcaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaaactgcaaataaaccccagaacagcgttccagagcaacctctccctgtcaactgtgtttctgagctgaggaagaggagcccatccatcgtagcctccaaccaaggaagggtgctacagaaagccaaggaatgggaacatgaagaagacctaggaagaggatgaggatttcattccaaaggaaataccagcttgtccacctgaggaagaaatgcttttttcacaaggagacaccaagagaagactaggaagtagccctcgttctccagggcacccaaaataccagcctttattgtctgcatgattttaggggatatggggagggaacaagtagaagggaagagggaaatggagagcatccttatgactttacaaagggtggaaatgaggatggagggatacagaagtctgcacagctgtaaaggttttatagatgtctttgccttcccttctgaggaagggaagaagtaatgaaagcacatgtgaataaccccttccatcccattcacagcatcgcactcccagtccttaaggcaaagggaggcagtgctgaagcattggtggtgcagtgtaaagagacaagacctgatcatctgatcacacttgtgccaacttgattcatattgggcattactaacaacccctgggcaaggtaaataggttgaacaatcaataacattatccctgcctgcatacatgtgaacaaaagctatagaggacatgcaaattctacagtcattcctcatatgctttagacagagtgcagctactggaatcttccagatttcagtgttttaaaatcagagctctgaatacacaaaaggaaagagaaatggagcagctgacatattttaagctcacagtgatactcagtgacaggagcacagagctctaatgtccacaggatgttgtagggtagggtctctcagtaaatcaagtcccttacctatgttctgacactgaggctcttggagctatgggttagaaatccaggaggcaatatgtctttattctaatgaagtcctcatcttgcactcagaggcccactagtttgcccttctatatattaagtaaaaccaagagaaattaagaggatgatggcttctttctgtcacatgggtgctaaaccttttacaaacacttgatacttctatagagggaccaaggacctcaagtcctgggcagtctccttactgtgctactcactactgtctcaacactgtagtgagtctgtctttaacacatttccttccaataaagataaaaccactta

SEQ ID NO: 309601 - DNA, 2559 bp, Homo sapiens
cttcaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaaactgcaaataaaccccagaacagcgttccagagcaacctctccctgtcaactgtgtttctgagctgaggaagaggagcccatccatcgtagcctccaaccaaggaagggtgctacagaaagccaaggaatgggaacatgaagaagacctaggaagaggatgaggatttcattccaaaggaaataccagcttgtccacctgaggaagaaatgcttttttcacaaggagacaccaagagaagactaggaagtagccctcgttctccagggcacccaaaataccagcctttattgtctgcatgattttaggggatatggggagggaacaagtagaagggaagagggaaatggagagcatccttatgactttacaaagggtggaaatgaggatggagggatacagaagtctgcacagctgtaaaggttttatagatgtctttgccttcccttctgaggaagggaagaagtaatgaaagcacatgtgaataaccccttccatcccattcacagcatcgcactcccagtccttaaggcaaagggaggcagtgctgaagcattggtggtgcagtgtaaagagacaagacctgatcatctgatcacacttgtgccaacttgattcatattgggcattactaacaacccctgggcaaggtaaataggttgaacaatcaataacattatccctgcctgcatacatgtgaacaaaagctatagaggacatgcaaattctacagtcattcctcatatgctttagacagagtgcagctactggaatcttccagatttcagtgttttaaaatcagagctctgaatacacatgacaggagcacagagctctaatgtccacaggatgttgtagggtagggtctctcagtaaatcaagtcccttacctatgttctgacactgaggctcttggagctatgggttagaaatccaggaggcaatatgtctttattctaatgaagtcctcatcttgcactcagaggcccactagtttgcccttctatatattaagtaaaaccaagagaaattaagaggatgatggcttctttctgtcacatgggtgctaaaccttttacaaacacttgatacttctatagagggaccaaggacctcaagtcctgggcagtctccttactgtgctactcactactgtctcaacactgtagtgagtctgtctttaacacatttccttccaataaagataaaaccacttaactcttaagtgccagtgcttagctcaagaggaaagaaggaaaatcccagaataaccgtggccactttgctataggggttacatattttaacccacctaaggttttacagactttagcctcactcaaactttatcaccctctgaggtagctggagaccacagcaggaaaaataacctgaccagtaatcacccactgattagtggcagagcgtaggacttaggggttataagcccagatccagatagggctaggtttgagccatgcctctaatgaccagctgggtgaccttgggaaagtcacttgattgctctgattcttgttttccttatctgtgaaatgggactaacaattgttacttttctcccaagattgttgggaagatttaataagataatatatagtaggcatcttgcatagtgtctgagaaataagaaatgctcagtcaatagtggctctcattagccaggcatggtggtactcgcctgtagtcccagctactcaggaggctgaggcaggaggaccgcttgagcccaggagtttgagactgtagtgcactatgatcacgcctgtgaattgccactgcactccagcctaagcaaatagcaagaccccatctattaaaaaaaaaaagtggctattattagctatatcagaaatgt

SEQ ID NO: 309602 - DNA, 1651 bp, Homo sapiens
cttcaggcaagctgttcagaggacatgggtcgctggctcgggctgctgctggtggagatgggctccagagtcactccggaggcgctgcactatgactacgtggatgtggagaccttaaccagcatcgtcagtgctgggcgcaactccttcctatatgcaagatcctgccagaatcagtggcctgagccccgagtctatgatgatgttccttatgaaaagatgcaggacgaggagcccgagcgccccacaggggcccaggtgaagcgtcacgcctcctcctgcagtgagaagtcccatcgtgtggacccgcaggtcaaagtcaaacgccacgcctccagtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggagcaaaattaaaggctctggaagaagccgtggccaccctggaagctcagtgtcgggcaaaggaggagcgccggattgacctggagctgaagctggtggctgtgaaggagcgcttgcagcagtccctggcaggagggccagccctggggctctccgtgagcagcaagcccaagagtggggaaactgcaaataaaccccagaacagcgttccagagcaacctctccctgtcaactgtgtttctgagctgaggaagaggagcccatccatcgtagcctccaaccaaggaagggtgctacagaaagccaaggaatgggaacatgaagaagacctaggaagaggatgaggatttcattccaaaggaaataccagcttgtccacctgaggaagaaatgcttttttcacaaggagacaccaagagaagactaggaagtagccctcgttctccagggcacccaaaataccagcctttattgtctgcatgattttaggggatatggggagggaacaagtagaagggaagagggaaatggagagcatccttatgactttacaaagggtggaaatgaggatggagggatacagaagtctgcacagctgtaaaggttttatagatgtctttgccttcccttctgaggaagggaagaagtaatgaaagcacatgtgaataaccccttccatcccattcacagcatcgcactcccagtccttaaggcaaagggaggcagtgctgaagcattggtggtgcagtgtaaagagacaagacctgatcatctgatcacacttgtgccaacttgattcatattgggcattactaacaacccctgggcaaggtaaataggttgaacaatcaataacattatccctgcctgcatacatgtgaacaaaagctatagaggacatgcaaattctacagtcattcctcatatgctttagacagagtgcagctactggaatcttccagatttcagtgttttaaaatcagagctctgaatacacaaaaggaaagagaaatggagcagctgacatattttaagctcacagtgatactcagtgatacgattgctgcgtgcctgaattcacgcctgtatgttttcttcaacccaaaggttaaagaagactggaagttactgaagcgacgtgttaccaag

SEQ ID NO: 309603 - DNA, 529 bp, Homo sapiens
gctcctagtccgtgtgccctgtggcctcccttttgcttcttatttccttagaggattcacactaaatatatctaagggactaggtctaaatatttccatttcatagatggagaagttggggctgaaagagaagctgacaccacacaagtacctttgccagaggtcagaactgagggcctttcccttccccatatctctgcaggtgccaatcaatacaagtatggcaagaaccgagccgaggaggatgcccggaggtacttggtagaaaaagagaagctggagaaagagaaagagacgattcggacagagctgatagcactgagacaggagaagagggaactgaaggaagccattcggagcagcccaggtacctatgtgggtgtggtcctgagcacctatgggtggccagctcatccttgggtacagtaaagggaggtctcttgcacaagtcacctggtttcttacccaagagaagtgggcttctcctcccctcctccttctcctcctcctcctcttcttctcctcttca

SEQ ID NO: 309604 - DNA, 728 bp, Homo sapiens
tagcagttgatagtatttatttgttatcattgtaatagcatataccattcaaggtatagctattttttctcttctccccaaaaccttaattttttttttatactgagatcttcttattcaacccatatcaatttgactggacttgtagcattcaaatattaacacagatttcaaattttagaaagatatttgtactagaatacttgtcaggtaactctgtggtatttctattagtatggaaattgtttataaagacacactctgaatttttgtggtcaagtagggtttgtagaatctttgatagcccagcatgttaaaatgtaaatgttctagaaaaataatctttcactttccctgtgaaaagaccccgcaaaaaagttttttgaggggtgtgttaaatatataaattttgaaagacgtagacaaaatagttaactatctacttatgatatttaatagtttggccaggcatggcaactcatgcctgttgtaatcccagcgtattgggcggctgaggtaggaggattgtgtgagcccaggcgtttgagactgcagtgagctatggatcctgcctggatgacagggcaagaccccaagtcaaaaaaaaaaaaaaagtaatagtttaatgaacatttaaaaacacattgtttggaataatgtgtgttagtcttcagttatgtctttgacattcaaattttcatcctgagaaccactttttgagacatcta

SEQ ID NO: 309605 - DNA, 4156 bp, Homo sapiens
ctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgt

SEQ ID NO: 309606 - DNA, 3402 bp, Homo sapiens
cggggcagtttattatttttagaagaggcatatgaagtgtgtaggagtaaggggtcccaatgtctacagcttattttgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgt

SEQ ID NO: 309607 - DNA, 4059 bp, Homo sapiens
ctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgt

SEQ ID NO: 309608 - DNA, 3989 bp, Homo sapiens
tgccgaagacccgccttcttctccttaagcctgacggaatcacctgactcggaggcgctccctcagaaggaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgt

SEQ ID NO: 309609 - DNA, 3816 bp, Homo sapiens
aacgaggatcatgtttatgtttatggacagccaaatgatcctcgttggtaaaacgctggccacatccaggcgctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgt

SEQ ID NO: 309610 - DNA, 3594 bp, Homo sapiens
  misc_feature (39)..(39): n is a, c, g, or t
tcagctcggtcctgatttggttctgaagatacattaaanaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgt

SEQ ID NO: 309611 - DNA, 4230 bp, Homo sapiens
ctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagtgaatatattgctcgtgaaaggtgccagattgacagctttggaaactgaaggactctaattatccacagaccagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgt

SEQ ID NO: 309612 - DNA, 4045 bp, Homo sapiens
agcttacttatagtaacattccaacactttcggtgagattacccccaagaatattactaggattaatgtttgatatttatatctttttttaattaactaattcttccacgtgatctttcaaactatccaaaattagcattgattgacgtaatttcaagataatgtgccttctttaaaaagaactttgttcaaaatgcattatttgagagactttgtaaggactcagatataaggtatctgcttcctctttactgagaatatttttttgaggagggaaacattcttgccttgtttttgagattctgattatcctgttacatgtacctagtgatgaaagcaaccggaaatgaaagaaaagatatgctttatttatacagtaactgtgttcactcagtgttaggtttaagaaaaaaaggaaaaaaccaaaatggtaaaacctgttacagattatttcagaaattattacagtgtgttatttgttattatgtggaatgtataagaaaattcattgtatatatttttagaaaagcaaaattcattgttgaaattattttttatgcctaagtgtcacaagttttgacattcttcctttcatattcaaaatggaagtttgacagatctttgagaatttttgcattaatcactttgaatattatgaatttctaacagggaccattaagaaagaaattgtagaaactgaaaattaggaaagcacacgtctcagaaattgacaacttttgaaggataagtcaggatataagaccaaataaggatttggtatagagataaaatcagctggtgataaatttacaatgttctgattcttaaagtctcaaattattacaacagcagtaaagtacaaatctcattttgaatatattctctagcaattatttttccttatgtcatgcatagctcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgt

SEQ ID NO: 309613 - DNA, 3003 bp, Homo sapiens
tgccgaagacccgccttcttctccttaagcctgacggaatcacctgactcggaggcgctccctcagaaggaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgt

SEQ ID NO: 309614 - DNA, 4468 bp, Homo sapiens
ctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatactgctgataaagatgatagttcagaagacatttcagtgccgagtagtccacatacagaagctatacagcatagttcggtcagcacatccaatggagtcagttcaacctccaaggcagaagctgtagccacttcagtcctcacccagatggcggaccagagtacagagcctgctctttcacagatcgttatggctccttcctcccagtcacagccctcaggaagttgattaaaaacctgcagtacaacagttttagatactcattagtgacttcaaagggaaatcaaggaaagaccagtttccatttatgcgaaatctgtggttgtaaattttttttttttacttgaaattaaatttggctctaaagttggtgtagcagcagttgatcagactgaaaaacggtttttagtctctggaaaaagactgattttgctttttttataaatattattagatttattaatttttctgtgctcaatgtgtaaattgtattataattcattgtgatttatttcacttttaatttgctggtgttttaataaatgggggtgttactgaatctttcttcccacttccatttcttttgaccaccccttaaccctcaactgtgacggtagtagtattatcatttataccaaagttttgcatagtccctgttgactttgtaatgttaacggagtcataaaagcactaggcaagagaaagatagaaatttgcttttaatctttttgccttttattttgcacattatgcaaaaggaaaaacattaaagaacacttttttttaagtgagtgaaaacatggtaaagacatacagtgcttttatgcacattgttaagctaaatcaaggtcatttataatcattttccttttttatttaagattttaagtaaacaaattttagaattttcagcatttcaaaaatgattttatttttcaagtcttaaattcaatattttacacctatgttttgaggctaaaaatatgaaattatataatgtatgatacagggttatcaaatatctaataatttttgaaattagctcttgtttttggtttttttgttgttgtttttacagatttcaggttacaaactgcaaagtttatgcataattaagtatggtatggttgccagaaaagcctaaaattactacttagaaaatttaagactgtttacccccattgtcttgtacttgcgagctaacttgtactattcttgtgaaagcactgtcatcttttagtagcaaattttgataatgtttctcgtggaaaaaaaaatcagtatctatctttagaacaatgtaattataatgtgggaagtgtgcatgaatgagagagagtgtgtgtgtatctgtgtgtgtgtgcgcgtgtgtgtgtgtcttttaatagtttatgccagcaatctttgcttgaatgtttaacgatgccttcagtgtgatgctggccaatagatgattgcagtttaaaatgtcattattgtgcaggcttggataactaacattccatgatgtagcttgtttctgatgagatgattgtaggtacatttttctcattatccaatcatctgtgggatacttagttttctaatgtgccattatctatttttattctgcagttatgttcaaaatacagtacatattttaaaatagaataaattgttaaacataaaattttaaaagtagtagatgtgcgtaagaaaactttgtaaaatagttatgagtcctacccagtagcaacttctggcattcaagcaggattccactatgtaaatatctgtaatgcatttataataagttgtgtagtttgtcctgcatccatactacactatttgctaaagtctcagtgccatctcctaatgagactgacattttaaaagtctgtatggaatatccttgataattcaaggaaatatccctcctgcctaagttccaaactgggaaacattcaaattatataaatgacatttcaggactttaagtatgaagataatgggaattttattgttttgctttttaaaatgagagcatttttatttgataattttttttaaatttttaatttttaactaatttcattattttaaagtaatcagtttttcaaatcatgattttgatatcattattctaaggagttatctcaaaggcacaaaatatgaattctgcaagaaggctattttttattgtagtttgaatgggttaggaaaagcctcaatttttcactcttaagtccttcagtacatttttctttcatcttattacttatgcaagttaaggttctttggtaacagaattcttgcaactgtaaaataaaactacatagatgtaagaagtcatgtaaacggttaacaagcttaccaaggttagcaaaactttcattgtaaatcagtctgtactgagcaaataaaaatcattattagttgtataaacacaaattccattttgactttcaggatgtcatactacttctgtacctagcattttcagtccttatatttgcaatgttacacaaactgtactattttcttttatgtgcagtttgcatgagtaaaccatcagagaataaattctatctttaaattatgtcaaaaaaaaaaaaaaaaaaaaaaaaaaaattgtttgggcggcctcgaggcccttgagaaaaaaagtttctaaaacaatccgtggggcgcgccggccccaagtgaggcaccggtcgacccgtggcgccataagccggtcccccaaggaaaatcccggcccaggatcaagggctgggctttcctccacccaataaaaaaacgccgggggcaaccgggagggttcggaaccaactccagatggggtcccggaggccataacggctcttatcaccagggggtcaggcgagccgaataaatacagacaggggggagg

SEQ ID NO: 309615 - DNA, 1975 bp, Homo sapiens
ctcgcgagagaggacggaagcctgtgggagcccgtggcctttaaagtgccgttcagccttttcctccaggggtgctttgtaaacacggctgtgctcagggctcgcgggtgaccgaaaggatcatgaactagtgacctggaaagggtactagatggaaacttgagaaaggactgcttattgataacagctaaggtattcctggaagcagagtaaataaagctcatggcccaccagctagaaagtattcttgccatgagaaaaagaatgtgataagttattcaacttatgaaattcaagttacatgtgaattctgccaggcaatacaaggacctgtggaatatgagtgatgacaaaccctttctatgtactgcgcctggatgtggccagcgttttaccaacgaggatcatttggctgtccataaacataaacatgagatgacactgaaatttggtccagcacgtaatgacagtgtcattgtggctgatcagaccccaacaccaacaagattcttgaaaaactgtgaagaagtgggtttgtttaatgagttggcgagtccatttgagaatgaattcaagaaagcttcagaagatgacattaaaaaaatgcctctagatttatcccctcttgcaacacctatcataagaagcaaaattgaggagccttctgttgtagaaacaactcaccaggatagtcctttacctcacccagagtctactaccagtgatgagaaggaagtaccattggcacaaactgcacagcccacatcagctattgttcgtccagcatcattacaggttcccaatgtgctgcttacaagttctgactcaagtgtaattattcagcaggcagtaccttcaccaacctcaagtactgtaatcacccaggcaccatcctctaacaggccaattgtccctgtaccaggcccatttcctcttctgttacatcttcctaatggacaaaccatgcctgttgctattcctgcatcaattacaagttctaatgtgcatgttccagctgcagtcccactcgttcgaccagtcaccatggtgcctagtgttccaggaatcccaggtccttcctctccccaaccagtacagtcagaagcaaaaatgagattaaaagctgctttgacccagcaacatcctccagttaccaatggtgatactgtcaaaggtcatggtagcggattggttaggactcagtcagaggaatctcgaccgcagtcattacaacagccagccacatccactacagaaactccggcttctccagctcacacaactccacagacccaaagtacaagtggtcgtcggagaagagcagctaacgaagatcctgatgaaaaaaggagaaagtttttagagcgaaatagagcagcagcttcaagatgccgacaaaaaaggaaagtctgggttcagtctttagagaagaaagctgaagacttgagttcattaaatggtcagctgcagagtgaagtcaccctgctgagaaatgaagtggcacagctgaaacagcttcttctggctcataaagattgccctgtaaccgccatgcagaagaaatctggctatcatagtgagtaatgttccattacctatagccttaggctacgtcagtgaaataccgtcagagtgaactgagctgctactttaaaaatggagactgtgcttctaatattcaagattaaatatcagaatttctgtaaggttattatagaatgcagtagagaggtataattttttagaatctagagagtttgagttttcctgtttctagcttttttcctaagcgttactatagatcaacaaaatggattagctaataatttaaaatatactgtaagtacttgatgatattttgttcatcttctcaggataacactttgtcttagattgacagggtgaaacactacttttttcccagcctccgttcattaatgatgatatttttctttttaaaatcagctgactgcct

SEQ ID NO: 309616 - DNA, 769 bp, Homo sapiens
gacagtttttctcattttacaaattggagattgtcctaagtaaatccataacttttctcttcttttcaatactgctacacaggttatgcatttaagatgcaattaaaaataattaaattttgctatttgctttgctgtggttagaaaatgtatttttaaatgatatgattataggagtaaaaatactattgtatttttaagagacagttggtatgaatctcttttttaaaatttctcttcttttgtttttcttagccctgtaccaggcccatttcctcttctgttacatcttcctaatggacaaaccatgcctgttgctattcctgcatcaattacaagttctaatgtgcatgttccagctgcagtcccagtaagaaagttagactatttaaatctctatcgcaaaactgatctttgtagtcagaaaataaagttggctgcttgactggcttatgaaattgaatttaacataatattgattagcagttgatagtatttatttgttatcattgtaatagcatataccattcaaggtatagctattttttctcttctccccaaaaccttaattttttttttatactgagatcttcttattcaacccatatcaatttgactggacttgtagcattcaaatattaacacagatttcaaattttagaaagatatttgtactagaatacttgtcaggtaactctgtggtatttctattagtatggaaattgtttataaagacacactctgaatttttgtggtcaagtagggtttg

SEQ ID NO: 309617 - DNA, 733 bp, Homo sapiens
tgctagcaaccttgtttagatgtagatcttgtttagatgtagcaaccacttgacatttaatttatcatcttaaccttgaatgattctttgttttgttttttgttattgagatggagtctcacttccagcctgggcgacagagcgagactccatctccaaaaaaaaaaaaaagtgaggttgagatttgcatggtaccaaggcttacatgcttcagaatagatcaatggttattgtataagtaattttatcctaaaacattatgacattttttgtttcttattgagggtagataatgttaatattaaactactaataggaggcccttatcacttctcttttcattttttccatgcagtgataggtattattagaaaaaagttatttcttgagttacacctaagaggaagaagtaacatgatggaaagtggttggagatagcacccaattaacatcgacagccaagtcttctatttcagaatattgatttatttcgctttggcttttgatgccatcatgagatttaagtctgcagtttcaaaagctcatgctacttagaagagatgatttttgcagcttaaaaaattgcttgtgactgcagtatgtacacagttaaaaagctgttcactgcccctttcaaccttttcattttgagctttactaagagaatgcttttaggaacagaattcctaaagtgtaattttttatgtataaataaagttttatctatatctga

SEQ ID NO: 309618 - DNA, 4113 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttcctgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcggcttactgcaacctccgcctcctgggttcaagcgattctcctgcctcagtgtcccaagtagctgggactacaggcgtccaccatgcctggccaagacacaaatttttaatggaaaaatattctgattcccagttcatgtaagctttatgaaaattgagtatattgtttatatgatggtacaaattattcttcctctaataatagcagtacagtatattttttccatagcatcagtgtaaaccatagcaaactaaaggagcattgctattaaaaagatgaattagctgggcgcagtggctcatacctgtaatcccagctactcaggaggctgaagcaggagaattgcttgaacctaggaggcggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactgtgataggtattattagaaaaaagttatttcttgagttacacctaagaggaagaagtaacatgatggaaagtggttggagatagcacccaattaacatcgacagccaagtcttctatttcagaatattgatttatttcgctttggcttttgatgccatcatgagatttaagtctgcagtttcaaaagctcatgctacttagaagagatgatttttgcagcttaaaaaattgcttgtgactgcagtatgtacacagttaaaaagctgttcactgcccctttcaaccttttcattttgagctttactaagagaatgcttttaggaacagaattcctaaagtgtaattttttatgtataaataaagttttatctatatctga

SEQ ID NO: 309619 - DNA, 1407 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataagtaagtatatttcagtgaggtatattttaatactgatcaatgtgaacttttctaaatactctattgtctttaataattgtgctgaaatctatttccttttataatagattaaaaattttatatttttataagtaaacagtgatttttgaaaagtcagccttgtgggatgaaaaatatgtcttactggaaaaatccctcataataacctaatagggcattgctattaaaaatgctaaaataaaaattcagcttatgagaaatggc

SEQ ID NO: 309620 - DNA, 1312 bp, Homo sapiens
  misc_feature (41)..(41): n is a, c, g, or t
  misc_feature (83)..(83): n is a, c, g, or t
tttttttgagatgaagtctcactctgtagcccagactggantccggtggcacgatctcagctcactgtagcctctgcctcctnagttcaagtggttctcctgtctcagtctcccaagtagctggaactacagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataatgataggtattattagaaaaaagttatttcttgagttacacctaagaggaagaagtaacatgatggaaagtggttggagatagcacccaattaacatcgacagccaagtcttctatttcagaatattgatttatttcgctttggcttttgatgccatcatgagatttaagtctgcagtttcaaaagctcatgctacttagaagagatgatttttgcagcttaaaaaattgcttgtgactgcagtatgtacacagttaaaaagctgttcactgcccctttcaaccttttcattttgagctttactaagagaatgcttttaggaacagaattcctaaagtgtaattttttatgtataaataaagttttatctatatctga

SEQ ID NO: 309621 - DNA, 546 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgatggagtcttgctctgtcgcacaggctggagtgcaatggcgtgatcttggctcactgcaacctccactgccagaattcaagcaattcacctgcctcagcctcctgagtagctgggattacagacgcacaccaccatgcccagctaattttgtatttttagtagagacagggtttcaccatgttgcccaggctggtcccgaactcctgacctcgggtgatccgcccacctcggcctcccaaagtgctgggattacaggcgtgagccaccacacctggcccacaccattttttatcagctttctaatgcatatcccctgttgctgatctctcttgtctat

SEQ ID NO: 309622 - DNA, 3905 bp, Homo sapiens
tacgtcatttctcggcgccgggaaacctgccattcttcgctgctgatcgcgggattctttttggatagggttgacgttcgtggatagactcatatctgtgaccagtgtccgccaccgcggatggcaagagacctgatcggaccggccctgccgcccggcttcaaggcccgcggaacagcggaggacgaagagcgggacccgagccctgttgcaggaccagctctgccccctaattataaaagcagtagttcagattcatcagacagcgatgaagacagtagttctttgtacgaagaaggaaatcaagaatctgaagaagatgacagtggtccaactgcaagaaaacagaggaaaaatcaggatgatgacgatgatgatgatgatgggttttttggaccagcccttcctcctggatttaaaaagcaggatgattctcctccaaggcccataataggtcctgcattgccacctggtttcattaaatctacacagaaaagtgacaagggcagagatgatccaggacaacaggaaacagacagcagtgaagatgaggatattattggaccaatgcctgcaaaaggaccagttaactataatgtaacgacagagtttgaaaaaagggcccagagaatgaaagaaaaactgaccaaaggagatgatgattcatctaaacccattgtaagagagtcatggatgactgaacttcctccagaaatgaaagactttggtcttgggccaaggacttttaagagaagagctgatgacacatctggagatcgatcaatctggacagatactccagctgatagggaaaggaaagctaaggaaacacaagaagcaaggaagtcatccagtaagaaagatgaagaacatatattatcaggaagagataagagactggctgagcaggtatcttcatacaatgaatcaaaaagatcagaatctcttatggacatacatcataaaaagttaaagagtaaggctgctgaagacaaaaataagcctcaagagagaataccatttgaccgtgataaagatctcaaggttaatcggtttgatgaagctcagaaaaaagccctaataaaaaaatctagagaactaaacaccagattttcacacggcaaaggcaatatgtttttataaggggatttccctgtgcaatgaagaaaagttgaagaatactctttgtccatctttatttctttgtttttggcttcttaagattagagattactttaatcttaaaaaacatacaaatttaccttgttctgtatgtccttttaaggtcatgtggaaacataaaacgaatgttttttatgtagaacagaatattctatgtgcctttagcttctgtggaagtatggggaattatgggcttttcttcaaataattattttaagaggcttccattccccctgatttttgtggtgtctcacaagtaccctctaaggtctggtcaggactgaccaccaaatctctaccacagcctggacctccttgtgaaatatacctaacctgccctagagtcagtgtgtcaagtccttcctgtaaatccatgactttgaaatttgttgttttttccctttaaactgcagccagtgaatacaaatttacttgaaaatagagggtatggggttttgcctgttttgtaatcagtttgcttgttttagcactcagggctttttatttgttatttaattttttaattgtttttaagtcagaaagatctctgggttatctcatgtgctaaggaaaaactattttgctttttccaactttaatagttagtatttctaggggaggcaatcaagataagatatgccattaactgttagcattgtgaaatctgtaagactcaatctctgatctcaaccaaagctttctgagtcctggaactttgctttgggacaactttactttacccatttatatgctgtacttaacagtttgtagctaatttatggggtcatatcttttttttagctaatttacgggggtcatatcagtcatgaatagccttttttaaaaatttaataatccctgaatacaaaaatggaaatggaaaatttataatcataacccccctaattgggagtattataagtttgtaatgctttaagcactgcctcttaagatgataaatttataagatgagaaattctatttaaactattaaactattgttaaataaatgccaattctataagttatattttcttgcagattaatcccaattgttccactagtattctagttttgatgagacacaaatttttgttgttgtttatttttgtttttttgagagatggagtcttgctctgtcacccaggctggagtagagtggcgtgatctcggcttactgcaacctccgcctcctgggttcaagcgattctcctgcctcagtgtcccaagtagctgggactacaggcgtccaccatgcctggccaagacacaaatttttaatggaaaaatattctgattcccagttcatgtaagctttatgaaaattgagtatattgtttatatgatggtacaaattattcttcctctaataatagcagtacagtatattttttccatagcatcagtgtaaaccatagcaaactaaaggagcattgctattaaaaagatgaattagctgggcgcagtggctcatacctgtaatcccagctactcaggaggctgaagcaggagaattgcttgaacctaggaggcggaggttgcagtgagccaagatcacaccattgcattccagcctgggcaacaagagtgaaactccatctctaaataaataagtaaataaatagatgaatttttctcctaagcaaattgaaaaagcttcttgtgtactcaaaattgaacagagctaccttttgactaaaaatgtcatttttaatgagcagtattttctgaacacaaaattttgtacaagagtgtctccattgcattaatttaattttgttataattttttcccaatgaaaggaaaaaagtattttgtagctcctcttccttatgtaaattcttaacatatatttttgagaaatttgcattttttaaagtaaaattgttatctttggatacttacttttctttgttttcctcatttaaagagaatagggatatttctgtattatatatttactgtttcatccctcacctttggagtgaccatgaccttggcatgaaggagagaaacctctgctttccgcctattgcttccaggagttactaccttactggccttggagataatgctcttttgtgccaacctgaggataattttaacaaaatgtaaggccagtttcagaggttgttttgccccacagagagactaatcccaatacaagaatattgacaacaaaaggacaaagtagttattgcacaggacggaaaggtgtctttatttcatcccctccccacttccaaagatgcaaaaggcctaattgaatcaagtctcctttccatctggcaggagacattttaataaggactttttaatttcctacatttcttggccaagtgtcataggaatgtggcctcttttgaaatttaaaaatgaagaagaaaaaaagagcaacactaagttaatataatggagcagatacttttaatgttcttaccattgaatatgccatttaagtttgttatacttgaaattatatgatttttgtccagctctctaaattgtcatctccaatagatttagatgcttcaaatagtaaccacattactggtaagtaaacggtggggttattgggtttagcaagtggggaagtaaggggtgaacaaaacacgagagatggtggctacacccctactaagactgccttaccagataaatgaaatcctttttgtattaggcacaacatggtaaattaagtcttgctctaaaaaaaaagaaaa
